(12) United States Patent
Plasterk

(10) Patent No.: US 12,391,736 B2
(45) Date of Patent: Aug. 19, 2025

(54) OFF-THE-SHELF CANCER VACCINES

(71) Applicant: CureVac Netherlands B.V., Amsterdam (NL)

(72) Inventor: Ronald Hans Anton Plasterk, Amsterdam (NL)

(73) Assignee: CureVac Netherlands B.V., Amsterdam (NL)

( * ) Notice: Subject to any disclaimer, the term of this patent is extended or adjusted under 35 U.S.C. 154(b) by 1147 days.

(21) Appl. No.: 17/262,917

(22) PCT Filed: Jul. 25, 2019

(86) PCT No.: PCT/NL2019/050491
§ 371 (c)(1),
(2) Date: Jan. 25, 2021

(87) PCT Pub. No.: WO2020/022898
PCT Pub. Date: Jan. 30, 2020

(65) Prior Publication Data
US 2021/0238244 A1  Aug. 5, 2021

(30) Foreign Application Priority Data

Jul. 26, 2018 (NL) .................................... 2021400
Jan. 24, 2019 (NL) .................................... 2022447

(51) Int. Cl.
| | |
|---|---|
| *C07K 14/47* | (2006.01) |
| *A61K 39/00* | (2006.01) |
| *C07K 5/083* | (2006.01) |
| *C07K 7/08* | (2006.01) |
| *C12Q 1/6886* | (2018.01) |

(52) U.S. Cl.
CPC ...... *C07K 14/4748* (2013.01); *A61K 39/0011* (2013.01); *A61K 39/001151* (2018.08); *C07K 5/0808* (2013.01); *C07K 7/08* (2013.01); *C12Q 1/6886* (2013.01); *A61K 39/00* (2013.01); *A61K 2039/645* (2013.01); *C07K 2319/00* (2013.01); *C12Q 2600/156* (2013.01)

(58) Field of Classification Search
CPC .... C07K 14/4748; C07K 5/0808; C07K 7/08; C07K 2319/00; A61K 39/0011; A61K 39/001151; A61K 39/00; A61K 2039/645; A61K 2039/70; C12Q 1/6886; C12Q 2600/156
See application file for complete search history.

(56) References Cited

U.S. PATENT DOCUMENTS

| | | |
|---|---|---|
| 9,115,390 B2 | 8/2015 | Liss et al. |
| 2005/0112134 A1 | 5/2005 | Graddis et al. |
| 2007/0083334 A1 | 4/2007 | Mintz et al. |
| 2016/0069895 A1 | 3/2016 | Delamarre et al. |
| 2016/0101170 A1 | 4/2016 | Hacohen et al. |
| 2017/0028043 A1 | 2/2017 | Benz et al. |
| 2017/0028044 A1 | 2/2017 | Soon-Shiong et al. |
| 2017/0032082 A1 | 2/2017 | Nguyen et al. |
| 2017/0032103 A1 | 2/2017 | Nguyen et al. |
| 2017/0202939 A1 | 7/2017 | Carreno et al. |
| 2017/0312351 A1 | 11/2017 | Niazi et al. |
| 2018/0064793 A1 | 3/2018 | Mcgranahan et al. |
| 2018/0078624 A1 | 3/2018 | Zhou et al. |
| 2018/0078625 A1 | 3/2018 | Moon et al. |
| 2018/0318409 A1 | 11/2018 | Valiante et al. |
| 2018/0340944 A1 | 11/2018 | Han et al. |
| 2019/0022202 A1 | 1/2019 | Granum et al. |
| 2019/0030147 A1 | 1/2019 | Artomov et al. |
| 2019/0060428 A1 | 2/2019 | Fritsch |
| 2019/0083593 A1 | 3/2019 | Sahin et al. |
| 2019/0091316 A1 | 3/2019 | Soon-Shiong et al. |

FOREIGN PATENT DOCUMENTS

| | | | |
|---|---|---|---|
| EP | 2071334 A1 * | 6/2009 | ............. C07K 16/32 |
| WO | 1995032731 A2 | 12/1995 | |
| WO | 20040111075 A2 | 12/2004 | |
| WO | 2007101227 A8 | 9/2007 | |
| WO | 2011143656 A2 | 11/2011 | |
| WO | 2012159754 A2 | 11/2012 | |
| WO | 2014168874 A2 | 10/2014 | |
| WO | 2015095811 A2 | 6/2015 | |
| WO | 2016040900 A1 | 3/2016 | |
| WO | 2016154544 A1 | 9/2016 | |
| WO | 2016172722 A1 | 10/2016 | |

(Continued)

OTHER PUBLICATIONS

NLM, "*Homo sapiens* cyclin-dependent kinase inhibitor 1A (p21, Cip1) (CDKN1A), transcript variant 1, mRNA"; URL= https://www.ncbi.nlm.nih.gov/nuccore/NM_000389.2 ; Date= Feb. 24, 2008; Accessed Nov. 2, 2024 (Year: 2008).*

Rajasagi, M. et al., "Systematic identification of personal tumor-specific neoantigens in chronic lymphocytic leukemia", Blood, 2014; 124(3):453-462; ISSN 0006-4971.

Roudko, V. et al., "Widespread immunogenic poly-epitope frameshift mutations in microsatellite unstable tumors", bioRxiv 2019; doi: https://doi.org/10.1101/662262; pp. 1-53.

(Continued)

*Primary Examiner* — Anne M. Gussow
*Assistant Examiner* — Sydney Van Druff
(74) *Attorney, Agent, or Firm* — Verrill Dana, LLP

(57) ABSTRACT

The present invention relates generally to peptide comprising two or more tumor specific neo open-reading-frame peptides (NOPs), and isolated nucleic acids encoding such peptides, and the uses of these peptides and/or isolated nucleic acids to produce cancer vaccines and the like. With the present invention it becomes possible to provide off-the-shelf cancer vaccines and the like within a short period of time and for potentially 30% of the total population of patients suffering from cancer.

3 Claims, 6 Drawing Sheets
Specification includes a Sequence Listing.

(56) References Cited

FOREIGN PATENT DOCUMENTS

| | | | |
|---|---|---|---|
| WO | 2016187508 A2 | 11/2016 | |
| WO | 2016201049 A2 | 12/2016 | |
| WO | 2017020026 A1 | 2/2017 | |
| WO | 2017106638 A1 | 6/2017 | |
| WO | 2017118702 A1 | 7/2017 | |
| WO | 2017132547 A1 | 8/2017 | |
| WO | 2017139694 A1 | 8/2017 | |
| WO | 2017173321 A1 | 10/2017 | |
| WO | 2017177207 A1 | 10/2017 | |
| WO | 2017194170 A1 | 11/2017 | |
| WO | 2017223085 A2 | 12/2017 | |
| WO | 2018015433 A2 | 1/2018 | |
| WO | 2018026896 A1 | 2/2018 | |
| WO | 2018102584 A1 | 6/2018 | |
| WO | 2018136664 A1 | 7/2018 | |
| WO | 2018144082 A1 | 8/2018 | |
| WO | 2018144775 A1 | 8/2018 | |
| WO | 2018195357 A1 | 10/2018 | |
| WO | 2018200389 A1 | 11/2018 | |
| WO | 2018213803 A1 | 11/2018 | |
| WO | 2018223092 A1 | 12/2018 | |
| WO | 2018223094 A1 | 12/2018 | |
| WO | 2018224405 A1 | 12/2018 | |
| WO | 2018234506 A2 | 12/2018 | |
| WO | 2018234516 A2 | 12/2018 | |
| WO | 2019008364 A1 | 1/2019 | |
| WO | 2019008365 A1 | 1/2019 | |
| WO | WO-2019012082 A1 * | 1/2019 | ............ A61K 38/04 |
| WO | 2019036043 A2 | 2/2019 | |

OTHER PUBLICATIONS

Luhui, S. et al., "Abstract 469: Progress towards developing a universal, prophylactic cancer vaccine.", American Association for Cancer Research; vol. 73, No. 8, Suppl. 1, Apr. 2013 (Apr. 1, 2013).

Schwitalle, Y. et al., "Immunogenic peptides generated by frameshift mutations in DNA mismatch repair-deficient cancer cells", Cancer Immun. 2004 Academy of Cancer Immunology, CH-ISSN 1424-9734, vol. 4, Nr:1, pp. 1-10.

Koster, J. et al., "A library of Neo Open Reading Frame peptides (NOPs) as a sustainable resource of common neoantigens in up to 50% of cancer patients", Scientific Reports, 2019, vol. 9, Nr: 1.

Zhang, J. et al., "Using Frameshift Peptide Arrays for Cancer Neo-Antigens Screening", Scientific Reports, vol. 8, No. 1, (2018), pp. 1-10.

Batista, M. T. et al., "Abstract 1463: FAST vaccines based on frameshift neoantigens may have advantages over personal vaccines", Proceedings of American Association for Cancer Research Annual Meeting 2019, Mar. 29, 2019, vol. 79, Nr.: 13, pp. 1-2.

Orfanelli, T. et al., "Shared tumor antigens in uterine cancers with microsatellite instability: Putative targets for immunotherapeutic approaches", Gynecologic Oncology, Jun. 2019, 154(1):91, DOI: 10.1016/j.ygyno.2019.04.214.

Linnebacher et al., "Frameshift peptide-derived T-cell epitopes: a source of novel tumor-specific antigens", Int. J. Cancer: 93, pp. 6-11 (2001).

Schumacher et al., "Neoantigens in cancer immunotherapy", Science, 2015, vol. 348, Issue 6230, pp. 69-74.

Rahma et al., "A pilot clinical trial testing mutant von Hippel-Lindau peptide as a novel immune therapy in metastatic Renal Cell Carcinoma", Journal of Translational Medicine, 2010, 8:8, 9 pages.

Hacohen et al., "Getting Personal with Neoantigen-Based Therapeutic Cancer Vaccines", Cancer Immunol. Res., Jul. 2013; 1(1): 11-15, pp. 1-8.

Ito et al., "Cancer Neoantigens: A Promising Source of Immunogens for Cancer Immunotherapy", J Clin Cell Immunol 2015, 6:2, pp. 1-7.

Tomczak et al., "The Cancer Genome Atlas (TCGA): an immeasurable source of knowledge", Contemp Oncol (Pozn). 2015, 19 (1A): A68-A77.

The Cancer Genome Atlas Research Network. "Comprehensive molecular characterization of clear cell renal cell carcinoma", Nature (2013), 499, pp. 43-49.

Pavlopoulou et al., "Human cancer databases (review)", Oncology Reports, 33: pp. 3-18, 2015.

Rammensee, H-G et al., "Cancer Vaccines: Some Basic Considerations", Genomic and Personalized Medicine, 2009, Elsevier, pp. 573-589.

* cited by examiner

Normal protein

Protein with NOP in patient with frame shift mutation

Potential NOPs

OFF-THE-SHELF CANCER VACCINES

FIELD OF THE INVENTION

The present invention relates generally to vaccines for use in the treatment of cancer, wherein a vaccine is based on combining multiple tumor specific neo open-reading-frame peptides (NOPs) sequences in a single vaccine, preferably wherein said NOPs are derived from the same gene. The invention further relates to peptides comprising such sequences, nucleic acids encoding such peptides and methods for constructing such peptides, nucleic acids and vaccines.

BACKGROUND OF THE INVENTION

There are a number of different existing cancer therapies, including ablation techniques (e.g., surgical procedures and radiation) and chemical techniques (e.g., pharmaceutical agents and antibodies), and various combinations of such techniques. Despite intensive research such therapies are still frequently associated with serious risk, adverse or toxic side effects, as well as varying efficacy.

There is a growing interest in cancer therapies that aim to target cancer cells with a patient's own immune system (cancer vaccines). Such therapies may indeed eliminate some of the known disadvantages of existing therapies, or be used in addition to the existing therapies for additional therapeutic effect. Cancer vaccines or immunogenic compositions intended to treat an existing cancer by strengthening the body's natural defenses against the cancer and based on tumor-specific neoantigens hold great promise as next-generation of personalized cancer immunotherapy. Evidence shows that such neoantigen-based vaccination can elicit T-cell responses and can cause tumor regression in patients.

Typically the immunogenic compositions/vaccines are composed of tumor antigens (antigenic peptides or nucleic acids encoding them) and may include immune stimulatory molecules like cytokines and that work together to induce antigen-specific cytotoxic T-cells that target and destroy tumor cells. Vaccines containing tumor-specific and patient-specific neoantigens requires sequencing of the patients' genome, as well as the production of personalized compositions. Sequencing, identifying the patient's specific neoantigens and preparing such personalized compositions may require a substantial amount of time, time which may unfortunately not be available to the patient, given that for some tumors the average survival time after diagnosis is short, sometimes around a year or less.

Accordingly, there is a need for improved methods and compositions for providing subject-specific immunogenic compositions/cancer vaccines. In particular it would be desirable to have available a vaccine for use in the treatment of cancer, wherein such vaccine is suitable for treatment of a larger number of patients, and can thus be prepared in advance and provided off the shelf.

In light of this, products, compositions, systems, methods and uses that provide for vaccines for use in the treatment of cancer and that would take away some of the herein-described disadvantages would be highly desirable, but are not yet readily available. In particular there is a clear need in the art for off-the-shelf personalized vaccines which induce an immune response to tumor specific neo antigens. Accordingly, the technical problem underlying the present invention can be seen in the provision of such products, compositions, methods and uses for complying with any of the aforementioned needs.

The technical problem is solved by the embodiments characterized in the claims and herein below.

SUMMARY OF THE INVENTION

It is an aim of the present invention to provide for an off-the-shelf vaccine for the treatment of cancer in a subject.

It is an aim of the present invention to provide for an off-the-self vaccine wherein the vaccine comprises a peptide or protein, or a nucleic acid encoding such peptide or protein, the peptide or protein comprising at least two amino acid sequences that have been found in tumors in cancer patients, or encoded by genomes of the cancer cells in such cancer patients, and that are the consequence of frame-shift mutations that have been introduced in the genome of the cancer cells of cancer patients. The amino acid sequences are preferably selected from the sequences identified with SEQ ID Nos 1-4307.

It is an aim of the present invention to provide for an off-the-self vaccine wherein the vaccine comprises a peptide or protein, or a nucleic acid encoding such peptide or protein, the peptide or protein comprising all amino acid sequences that have been found in tumors in cancer patients, or encoded by genomes of the cancer cells in such cancer patients, and that are the consequence of frame-shift mutations that have been introduced in one and the same gene in the genome of the cancer cells of cancer patients. The genes and amino acid sequences are preferably selected from the genes identified as groups 1-1103 in Table 1, and the accompanying SEQ ID nos. per gene.

By identifying in a cancer patient the genes as disclosed herein and that have been hit by frameshift mutations causing the genome of the cancer cells to encode for peptides comprising the amino acid sequences as disclosed herein, the patient can be provided with, depending on the number of genes that have been hit with such frameshift mutation, one, two or more peptides according to the invention, wherein a first peptide comprises for a first hit gene (i.e. a first group in Table 1) at least two, preferably all, of the corresponding amino acid sequences as indicated in Table 1 (or an isolated nucleic acid encoding such peptide), a second peptide comprises for a second hit gene (i.e. a second group in Table 1) at least two, preferably all, of the corresponding amino acid sequences as indicated in Table 1 (or an isolated nucleic acid encoding such peptide), and so on.

It is also an aim of the present invention to provide for an off-the-self vaccine wherein the vaccine comprises a peptide or protein, or a nucleic acid encoding such peptide or protein, the peptide or protein comprising at least two amino acid sequences that are also present in the tumor of the patient, or encoded by the genome of the cancer cells, and that are the consequence of frame-shift mutations that have been introduced in the genome of the cancer cells.

It is an aim of the current invention that the peptide or protein comprising all amino acid sequences that are also present in the tumor of the patient, or encoded by the genome of the cancer cells, and that are the consequence of frame-shift mutations that have been introduced in the genome of the cancer cells. By providing one peptide or protein, or nucleic acid encoding such protein or peptide, comprising all such amino acid sequences, it has now become possible to treat a cancer patient with one vaccine and that comprises all amino acid sequences that are unique to the cancer cell as the consequence of frame-shift mutations that are present in the genome of the cancer patient. Preferably all the amino acid sequences that are present in the tumor of a patient are selected from the group consisting of SEQ ID Nos 1 to 4307.

It is an aim of the present invention to provide for a peptide comprising at least two amino acid sequences, wherein each of said amino acid sequence is independently selected from the group consisting of SEQ ID Nos 1 to 4307.

It is a further objective of the present invention to provide for an isolated nucleic acid comprising a nucleotide sequence encoding said peptide.

It is a further objective of the present invention to provide for a vector comprising said isolated nucleic acid.

It is a further objective of the present invention to provide for an expression vector comprising a promoter operably linked to said isolated nucleic acid.

It is a further objective of the present invention to provide for a host cell comprising said isolated nucleic acid.

It is a further objective of the present invention to provide for a vaccine comprising said peptide, or said isolated nucleic acid, or said vector, or said expression vector, optionally further comprising a pharmaceutically acceptable excipient.

It is a further objective of the present invention to provide for said vaccine for use in the prevention or treatment of a disease, preferably wherein said disease is cancer.

It is a further objective of the present invention to provide for a library comprising 2, 3, 4, 5, 6, 7, 8, 9, 10, 20, 30, or more vaccines according to the invention, each vaccine individually comprising at least two, preferably all, amino acid sequences selected from a group selected from the groups 1-1103 as listed in Table 1, or a nucleotide sequence encoding said amino acid sequences, and wherein said 2, 3, 4, 5, 6, 7, 8, 9, 10, 20, 30, or more vaccines each comprise amino acid sequences, or nucleotide sequences encoding said amino acid sequences, from a different group selected from the groups of sequences listed in Table 1.

It is a further objective of the present invention to provide for a method for generating a nucleic acid coding for a peptide, the method comprising the steps of:
  a) identifying frame shift mutations in the tumor DNA and/or RNA of a cohort of cancer patients in order to obtain a frame shift library;
  b) identifying at least one gene which is changed by a frame shift mutation in the tumor DNA and/or RNA of one or more patients in the cohort of cancer patients to obtain a frame shift gene;
  c) identifying each novel open reading frame in both the +1 and −1 reading frame that overlaps with or is adjacent to the frame shift location of the frame shifted gene to obtain candidate novel open reading frame sequences;
  d) optionally when present, identifying each novel open reading frames in both the +1 and −1 reading frame that overlaps with or is adjacent to the frame shift location for each alternative splicing construct of the frame shift gene to obtain candidate novel alternative splicing open reading frame sequences;
  e) combining each of the candidate open reading frame sequences and optionally the candidate novel alternative splicing open reading frame sequences of the frame shift gene in a nucleic acid construct.

This and other objectives are provided by the peptides, isolated nucleic acids, vectors, expression vectors, host cells, vaccines, vaccine compositions, compositions for use and methods as defined throughout the description and as defined in the claims.

BRIEF DESCRIPTION OF THE DRAWINGS

Embodiments of the invention are further described hereinafter with reference to the accompanying drawings, in which.

REFERENCE TO A SEQUENCE LISTING

Figure 1:
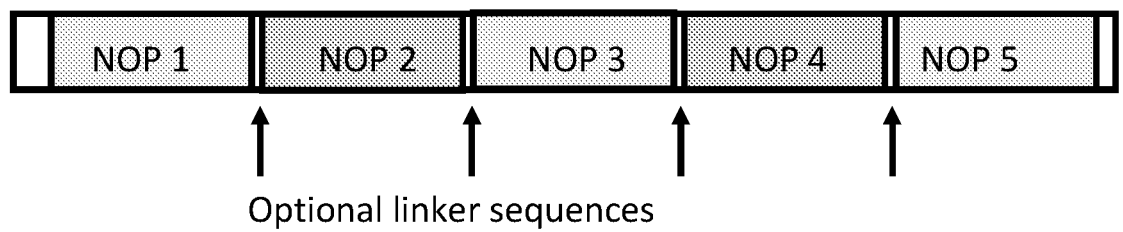
FIG. 1: Schematic overview of a polyNOP peptide, an example of a peptide according to the invention and comprising multiple NOP amino acid sequences which are optionally linked by an amino acid linker sequence, as indicated.
Figure 2:
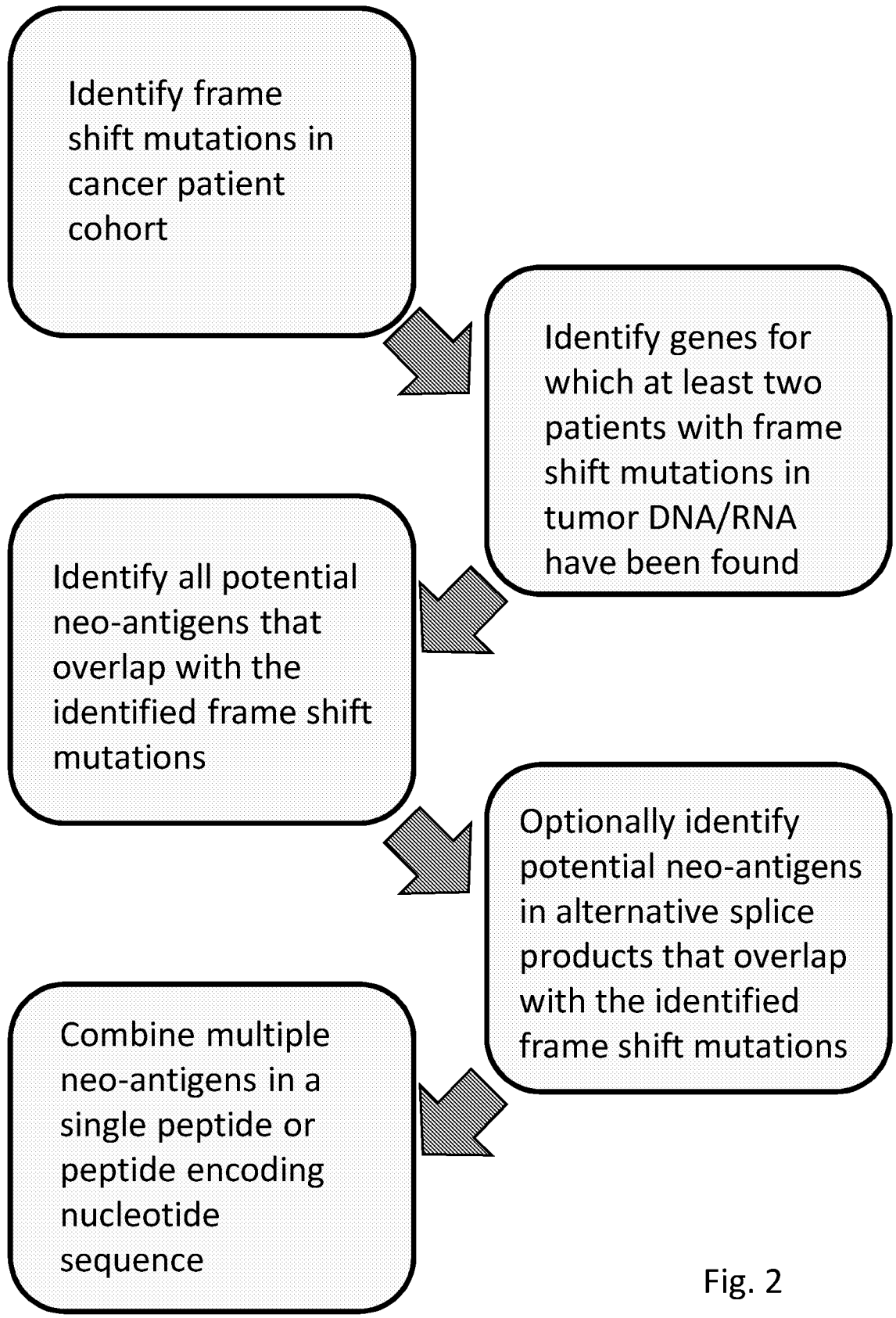
FIG. 2: Schematic overview of a method according to the invention to select candidate NOPs and subsequent construction of a polyNOP peptide according to the invention.

The Sequence listing, which is a part of the present disclosure, includes a text file comprising amino acid sequences of the present invention. The subject matter of the Sequence listing is incorporated herein by reference in its entirety. The information recorded in computer readable form is identical to the written sequence listing.

DEFINITIONS

The section headings used herein are for organizational purposes only and are not to be construed as limiting the subject matter described.

A portion of this disclosure contains material that is subject to copyright protection (such as, but not limited to, diagrams, device photographs, or any other aspects of this submission for which copyright protection is or may be available in any jurisdiction). The copyright owner has no objection to the facsimile reproduction by anyone of the patent document or patent disclosure, as it appears in the Patent Office patent file or records, but otherwise reserves all copyright rights whatsoever.

Various terms relating to the methods, compositions, uses and other aspects of the present invention are used throughout the specification and claims. Such terms are to be given their ordinary meaning in the art to which the invention pertains, unless otherwise indicated. Other specifically defined terms are to be construed in a manner consistent with the definition provided herein. Although any methods and materials similar or equivalent to those described herein can be used in the practice for testing of the present invention, the preferred materials and methods are described herein.

For purposes of the present invention, the following terms are defined below.

The singular form terms "A," "an," and "the" include plural referents unless the content clearly dictates otherwise. Thus, for example, reference to "a cell" includes a combination of two or more cells, and the like.

As used herein, the term "about," when referring to a value or to an amount of mass, weight, time, volume, concentration or percentage is meant to encompass variations of in some embodiments ±20%, in some embodiments ±10%, in some embodiments ±5%, in some embodiments ±1%, in some embodiments ±0.5%, and in some embodiments ±0.1% from the specified amount, as such variations are appropriate to perform the disclosed method.

As used herein, ranges can be expressed as from "about" one particular value, and/or to "about" another particular value. It is also understood that there are a number of values disclosed herein, and that each value is also herein disclosed as "about" that particular value in addition to the value itself. For example, if the value "10" is disclosed, then "about 10" is also disclosed. It is also understood that each unit between two particular units are also disclosed. For example, if 10 and 15 are disclosed, then 11, 12, 13, and 14 are also disclosed.

The term "and/or" refers to a situation wherein one or more of the stated cases may occur, alone or in combination with at least one of the stated cases, up to with all of the stated cases.

As used herein, the term "at least" a particular value means that particular value or more. For example, "at least 2" is understood to be the same as "2 or more" i.e., 2, 3, 4, 5, 6, 7, 8, 9, 10, 11, 12, 13, 14, 15 . . . etc. As used herein, the term "at most" a particular value means that particular value or less. For example, "at most 5" is understood to be the same as "5 or less" i.e., 5, 4, 3 . . . −10, −11, etc.

The term "comprising" is construed as being inclusive and open ended, and not exclusive. Specifically, the term and variations thereof mean the specified features, steps or components are included. These terms are not to be interpreted to exclude the presence of other features, steps or components. It also encompasses the more limiting "to consist of".

"Exemplary" means "serving as an example, instance, or illustration," and should not be construed as excluding other configurations disclosed herein.

As used herein, administration or administering in the context of treatment or therapy of a subject is preferably in a "therapeutically effective amount", this being sufficient to show benefit to the individual. The actual amount administered, and rate and time-course of administration, will depend on the nature and severity of the disease being treated. Prescription of treatment, e.g. decisions on dosage etc., is within the responsibility of general practitioners and other medical doctors, and typically takes account of the disorder to be treated, the condition of the individual patient, the site of delivery, the method of administration and other factors known to practitioners.

As used herein, "therapy" or "treatment" refers to treatment of a tumor with a therapeutic substance. A treatment may involve administration of more than one substance. A substance may be administered alone or in combination with other treatments, either simultaneously or sequentially dependent upon the condition to be treated. For example, the therapy may be a co-therapy involving administration of two agents, one or more of which may be intended to treat the tumor. The substances may be administered simultaneously, separately, or sequentially which may allow the agents to be present in the patient requiring treatment at the same time and thereby provide a combined therapeutic effect, which may be additive or synergistic. The therapy may be administered by one or more routes of administration, e.g. parenteral, intra-arterial injection or infusion, intravenous injection or infusion, intraperitoneal, intratumoral or oral. The therapy may be administered according to a treatment regime. The treatment regime may be a pre-determined timetable, plan, scheme or schedule of therapy administration which may be prepared by a physician or medical practitioner and may be tailored to suit the patient requiring treatment. The treatment regime may indicate one or more of: the type of therapy to administer to the patient; the dose of each drug; the time interval between administrations; the length of each treatment; the number and nature of any treatment holidays, if any etc. For a co-therapy a single treatment regime may be provided which indicates how each drug/agent is to be administered.

This term "cancer" refers to the physiological condition in mammals that is typically characterized by unregulated cell growth. The terms "cancer," "neoplasm," and "tumor," are often used interchangeably to describe cells that have undergone a malignant transformation that makes them pathological to the host organism. Primary cancer cells can be distinguished from non-cancerous cells by techniques known to the skilled person. A cancer cell, as used herein, includes not only primary cancer cells, but also cancer cells derived from such primary cancer cell, including metastasized cancer cells, and cell lines derived from cancer cells. Examples include solid tumors and non-solid tumors or blood tumors. Examples of cancers include, without limitation, leukemia, lymphoma, sarcomas and carcinomas (e.g. colon cancer, pancreatic cancer, breast cancer, ovarian cancer, glioblastoma, prostate cancer, lung cancer, melanoma, lymphoma, non-Hodgkin lymphoma, colon cancer, (malignant) melanoma, thyroid cancer, papillary thyroid carcinoma, lung cancer, non-small cell lung carcinoma, and adenocarcinoma of lung). As is well known, tumors may metastasize from a first locus to one or more other body tissues or sites. Reference to treatment for a "neoplasm, "tumors" or "cancer" in a patient includes treatment of the primary cancer, and, where appropriate, treatment of metastases.

As used herein the term "antigen" is a substance, preferably a (poly) peptide that induces an immune response.

As used herein the term "neoantigen" or "neoantigenic peptide" is an antigen that has at least one alteration that makes it distinct from the corresponding wild-type, parental antigen, e.g., via mutation in a tumor cell. A neoantigen can include a polypeptide sequence or a nucleotide sequence. The term "neoantigenic peptide" also encompasses a nucleotide sequence encoding such neoantigen peptide. A tumor neoantigen" or "tumor-specific neoantigen" is a neoantigen present in a subject's tumor cell or tissue but not in the subject's corresponding normal cell or tissue. The neoantigen of the present invention are tumor-specific neoantigens.

As used herein the term "epitope" is the specific portion of an antigen typically bound by an antibody or T cell receptor. As used herein the term "neoepitope" is the specific portion of a neoantigen typically bound by an antibody or T cell receptor.

The term "peptide" is used herein interchangeably with "mutant peptide" and "neoantigenic peptide" to designate a series of residues, typically L-amino acids, connected one to the other, typically by peptide bonds between adjacent amino acids. Similarly, the term "polypeptide" is used interchangeably with "mutant polypeptide" and "neoantigenic polypeptide" in the present specification to designate a series of residues, typically L-amino acids, connected one to the other, typically by peptide bonds between the adjacent amino acids. The polypeptides or peptides can be a variety of lengths. Particularly the term "peptide" is also used for novel amino acid sequences comprising two or more (neoantigenic) peptides, also referred to herein as polyNOP.

In certain embodiments the size of the at least one neoantigenic peptide (NOP) molecule may comprise, but is not limited to, about 5, about 6, about 7, about 8, about 9, about 10, about 11, about 12, about 13, about 14, about 15, about 16, about 17, about 18, about 19, about 20, about 21, about 22, about 23, about 24, about 25, about 26, about 27, about 28, about 29, about 30, about 31, about 32, about 33, about 34, about 35, about 36, about 37, about 38, about 39, about 40, about 41, about 42, about 43, about 44, about 45, about 46, about 47, about 48, about 49, about 50, about 60, about 70, about 80, about 90, about 100, about 110, about 120 or greater amino acid molecule residues, and any range derivable therein. In specific embodiments the neoantigenic peptide molecules are equal to or less than 50 amino acids.

In certain embodiments the size of the at least one peptide according to the invention (polyNOP) may comprise, but is not limited to, about 20, about 21, about 22, about 23, about 24, about 25, about 26, about 27, about 28, about 29, about 30, about 35, about 40, about 45, about 50, about 60, about 70, about 80, about 90, about 100, about 120, about 140, about 160, about 180, about 200, about 250, about 300, about 350, about 400, about 500, about 600, about 700, about 800, about 900, about 1000, about 1100, about 1200, about 1300, about 1400, about 1500, about 1600, about 1700, about 1800, about 1900, about 2000, about 2200, about 2400, about 2600, about 2800, about 3000, about 3500, about 4000, about 4500 or greater amino acid molecule residues, and any range derivable therein. In specific embodiments the peptide according to the invention are equal to or less than 1000 amino acids.

The neoantigens and polypeptides preferably does not induce an autoimmune response and/or invoke immunological tolerance when administered to a subject.

As used herein the term "ORF" means open reading frame. As used herein the term "neoORF" is a tumor-specific ORF arising from a mutation, in particular a frame shift mutation as described herein. A "frame shift mutation" is a mutation causing a change in the frame of the protein, for example as the consequence of an indel mutation as described herein.

Within the context of the current invention the mutation in the tumor cell that gives rise to the neoantigen is a frame shift mutation with a net change of sequence, compared to wildtype, that is not + or − 3 nucleotides or a multiplicity thereof (6, 9, 12, 15 etc.). For example the frame shift consists + or − 1, 2, 4, 5, 7, 8 . . . nucleotides. As will be understood by the skilled person, the frame shift mutation within the context of the current invention and should not create a novel stop triplet on the spot. The frame shift within the context of the current invention gives rise to a neoORF, a novel open reading frame generated in the tumor by insertions, deletions or substitutions that bring in frame sequences encoding completely novel stretches of amino acids. The frame shift mutation within the context of the current invention is a mutation that occurs in the coding region of a gene; i.e. the region that encodes a protein. (Note that the new open reading frame can sometimes extend beyond the stop codon of the wild type gene).

When referring herein to reading frame, the +1 and −1 reading frame mean those reading frames starting at one nucleotide downstream or upstream respectively. It is further to be understood that the −1 reading frame is the same as the +2 reading frame, or the +5 reading frame, etc. Similarly, the +1 reading frame is the same as the −2 reading frame or the +4 reading frame, etc.

As used herein the term "immunogenic" is the ability to elicit an immune response, e.g., via T cells, B cells, or both. As used herein, an immunogenic composition is a composition comprising substances, in particular neoantigen with the ability to elicit an immune response. Such composition may for example be a neoantigen-based vaccine based on one or more neoantigens, e.g., a plurality of neoantigens.

As used herein the term "sequence" can refer to a peptide sequence, DNA sequence or RNA sequence. The term "sequence" will be understood by the skilled person to mean either or any of these, and will be clear in the context provided. For example, when comparing sequences to identify a match, the comparison may be between DNA sequences, RNA sequences or peptide sequences, but also between DNA sequences and peptide sequences. In the latter case the skilled person is capable of first converting such DNA sequence or such peptide sequence into, respectively, a peptide sequence and a DNA sequence in order to make the comparison and to identify the match.

As used herein the term "exome" is a subset of the genome that codes for proteins. An exome can be the collective exons of a genome.

As used herein the term "transcriptome" is the set of all RNA molecules is a cell or population of cells. In a preferred embodiment the transcriptome refers to all mRNA.

As used herein the term "sample" can include a single cell or multiple cells or fragments of cells or an aliquot of body fluid, taken from a subject, by means including venipuncture, excretion, ejaculation, massage, biopsy, needle aspirate, lavage sample, scraping, surgical incision, or intervention or other means known in the art.

As used herein the term "subject" encompasses a cell, tissue, or organism, human or non-human, whether in vivo, ex vivo, or in vitro, male or female. The term subject is inclusive of mammals including humans. Preferably the subject is a human subject diagnosed with cancer or suspected to have cancer.

As used herein the term "mammal" encompasses both humans and non-humans and includes but is not limited to humans, non-human primates, canines, felines, murines, bovines, equines, and porcines.

As used herein, we define a NeoORFeome as the set of all sequences in the human genome that are out of frame with known translated genes, but that as a result of a frame shift mutation can become in frame and encode a novel peptide of at least 8 or 10 amino acids in length before encountering a stop codon. The NeoORFeome is the complete space in which by single frame shift mutations novel peptides of significant length (here defined as 10 amino acids or longer) can be encoded and (potentially) expressed. In other words, the NeoORFeome comprises the complete set of neo Open Reading Frame in the human genome, defined as the sum of open reading frames that are not found in frame in the wild type human genome without mutation, but which by a single insertion/deletion/substitution can be made to be in frame, and then encode a peptide of at minimal length 8, 10 amino acids. The human NeoORFeome as here defined in its latest version (in which peptides whose initiations are in the UTR are removed) comprises 25,617,715 amino acids, approximately 26 million. This corresponds to approximately 105 Mb (Megabases) of encoding DNA. (The Human Genome is around 3000 Mb).

We define herein peptides that are not encoded by the wild type human genome, but after frame shift mutation as defined herein, and can be encoded by a tumor genome as a novel open reading frame peptide, or NOP. For any potential NOP in the NeoORFeome the C-terminal sequence is fixed (bounded by the encounter of a stop codon) and not dependent on the precise location of the frame shift mutation; the N-terminus, however, is defined by the mutation site, which is where potentially protein translation shifts into the novel frame. The most upstream novel sequence of a NOP is the most 5' triplet in the wild type human genome of the Neo Open Reading Frame sequence which is not a stop triplet. We define the potential NOPs, also referred to as the pNOPs, as the amino acid sequences encoded by the longest possible sequence, so from the most upstream triplets as described to the stop triplet at the 3' end. Sequences of such potential NOPs are represented in the amino acid sequences as defined herein as NOPs, a selection of potential NOPs is represented by the sequence listing (SEQ ID Nos 1-4307).

Indeed the selection of pNOPs represented by the sequence listing is defined as (part of) the subset of the Neo-Orfeome which we found to be the most frequently switched on by frame shift mutation in a very large set of tumor sequence data; it is thus a listing of potential NOPs or pNOPs. The complete sequence listing (SEQ ID Nos 1-4307) contains pNOPs that are encountered in over 44% of all cancers as described in the TCGA database. Based on our analysis for any new tumor of which the genome (or transcriptome or exome or ORFeome—which is also included in any of the embodiments described below referring to genome, exome or transcriptome) is sequenced, the chance is over 30% that it will encode a NOP that is listed in our library as described here. In other words: the NOPs as provided by the sequence listing (SEQ ID Nos 1-4307) can potentially provide to over 44% of all cancer patients.

As used herein, we define polyNOP as a peptide which comprises at least two NOPs, preferably selected from SEQ ID 1-4307, which NOPS may, within the peptide, be adjacent to each other or be separated by, for example, small amino acid linkers (as will be discussed in more detail herein). As NOPs are defined by out of frame open reading frame peptides which are flanked by stop codons, it logically follows that multiple NOPs combined in one peptide or encoded in a single open reading frame is unlikely to occur in nature. PolyNOPs can for example be constructed by linking multiple NOP encoding nucleic acid sequences, with or without linker sequence, and in the same reading frame, followed by expression of the amino acid sequence encoded by such nucleic acid. It is disclosed herein that polyNOPs according to the invention may comprise two or more NOPs derived from the same gene or two or more NOPs derived from different genes. Preferably a polyNOP comprises 2, 3, 4, 5, 6, 7, 8, 9, 10, 11, 12, 13, 14, 15, 16, 17, 18, 19, 20 or more NOPs, preferably, when the NOPs in a polyNOP are all obtained from the same gene, in a preferred embodiment, the peptide comprises all NOPs as defined herein for said gene.

When used herein, candidate NOP means a NOP which overlaps or is adjacent to a frame shift mutation is defined herein.

As used herein "off-the-shelf" means a vaccine or vaccine composition, e.g. comprising one or more peptides or nucleic acids as defined herein that is available and ready for administration to a patient. For example, when a certain frame shift mutation is identified in a patient, the term "off-the-shelf" would refer to a vaccine according to the invention that is ready for use in the treatment of the patient, meaning that, if the vaccine is peptide based, the corresponding polyNOP peptide may, for example already be expressed and for example stored with the required excipients and stored appropriately, for example at −20° C. or −80° C. Preferably the term "off-the-shelf" also means that the vaccine has been tested, for example for safety or toxicity. More preferably the term also means that the vaccine has also been approved for use in the treatment or prevention in a patient.

As used herein "overlap", when referring to a frame shift mutation to overlap with a NOP or vice versa, means that from all potential NOPs as encoded by the +1 and −1 reading frame for a certain gene, those NOPs are said to overlap with the frame shift location that contain an amino acid sequence that can be encoded by the sequence surrounding the frame shift location in the +1 reading frame and in the −1 reading frame.

For example in case of an insertion, if the non-frame shifted protein is encoded by the sequence: [sequence_1][sequence_2] and encodes the amino acid sequence RHDGCRP, and the frame shift encoding sequence from a patients is [sequence_1]C[sequence_2] (insertion) and encodes the amino acid sequence: RHDALSA, then NOPs that overlap with the frame shift location are the NOP for which a part of the sequence can be encoded by [sequence_1][sequence_2] in reading frame +1 and the NOP for which a part of the sequence can be encoded by [sequence_1][sequence_2] in reading frame-1, for example the NOPs comprising the amino acids sequences VTTAVG and SRRLSA respectively.

For example in case of an deletion, if the non-frame shifted protein is encoded by the sequence: [sequence_1]AT[sequence_2] and encodes the amino acid sequence RHD-GIVG, and the frame shift encoding sequence from a patients is [sequence_1][sequence_2] (deletion) and encodes the amino acid sequence: RHDGCRP, then NOPs that overlap with the frame shift location are the NOP for which a part of the sequence can be encoded by [sequence_1][sequence_2] in reading frame +1 and the NOP for which a part of the sequence can be encoded by [sequence_1][sequence_2] in reading frame-1, for example the NOPs comprising the amino acids sequences VTTALSA and SRRHCRP respectively.

In case the frame shift location is very close or at the border of two neighboring NOPs (for example due to an out of frame stop codon), the NOPs are referred herein as "adjacent", and defined as comprising a stretch of amino acids encoded by nucleotides corresponding to for example 9 consecutive nucleotides, or 10, 11, 12, 13, 14, 15, 16, 17 or 18 consecutive nucleotides, starting from 3 nucleotides upstream or downstream from the location of the frame shift location and which are not defined as overlapping as defined above.

For example, if the non-frame shifted protein is encoded by [sequence_1]GCGCTGT[sequence_2] and the frame shift encoding sequence is [sequence_1]GCGTGT[sequence_2], then the NOPs that comprise an amino acid sequence that can be encoded by either nucleic acid sequence 1 or nucleic acid sequence 2 in either reading frame +1 or reading frame −1 are said to be adjacent, provided they are not already defined as overlapping as defined above.

DETAILED DESCRIPTION

NOP sequences (also referred to as neo Open Reading Frames, neoORFs) have been previously described as potential cancer vaccines. See, for example, WO95/32731, WO2016172722 (Nantomics), WO2016/187508 (Broad), WO2017/173321 (Neon Therapeutics), US2018340944 (University of Connecticut), and WO2019/012082 (Nouscom), as well as Rahma et al. (Journal of Translational Medicine 2010 8:8) which describes peptides resulting from frameshift mutations in the von Hippel-Lindau tumor suppressor gene (VHL) and Rajasagi et al. (Blood 2014 124 (3): 453-462) which reports the systematic identification of personal tumor specific neoantigens.

The present disclosure uses NOP sequences that are shared among cancer patients to generate combinations of NOP sequences. The preferred combinations of NOP sequences, as claimed herein, can be used as off-the-shelf therapeutic vaccines for a large proportion of cancer patients or for prophylactic use. The combination of the specific shared NOP sequences into a single vaccine and the use of the preferred combinations for treatment or prevention of cancer has not been described before in the art.

It is contemplated that any method, use or composition described herein can be implemented with respect to any other method, use or composition described herein. Embodiments discussed in the context of methods, use and/or compositions of the invention may be employed with respect to any other method, use or composition described herein. Thus, an embodiment pertaining to one method, use or composition may be applied to other methods, uses and compositions of the invention as well.

As embodied and broadly described herein, the present invention is directed to the surprising finding that developing a vaccine for neo open reading frame peptides (antigens) from frame shift mutations in relatively few genes are sufficient to develop a potential vaccines for a large percentage of cancer patients.

It was realized by the inventor of the present invention that it is possible to provide a peptide that comprises (sequences of) neo open reading frame peptides that are found in tumor material of patients as the consequence of frame shift mutations that lead to a new open reading frame with a novel, common, tumor-specific protein sequence towards the C-terminal end, preferably comprising two or more sequences as defined in the sequence listing (SEQ ID Nos 1-4307). By comparing sequence information from a tumor sample of a patient with the sequence listing it has now become possible to quickly identify whether there is a match between sequences identified in the patient's material with a sequence in the sequence listing. A match is identified when a sequence identified in the patients material and a sequence from the sequence listing have a string, i.e. a peptide sequence (or RNA or DNA sequence encoding such peptide (sequence) in case the comparison is on the level of RNA or DNA) in common representative of at least 8, preferably at least adjacent amino acids. The thus identified tumor-specific mutant polypeptide encoded by a tumor-specific frame shift mutation in (expressed) genes of the subject having cancer can be used to provide for neoantigens comprising a tumor-specific neoepitope. With these limited amount of sequences, and based on the actual amount of sequences in the sequence listing (as described herein elsewhere) it is estimated that between about 5-30% of the population of patients having cancer can be provided with a subject-specific and tumor-specific immunogenic composition comprising one or more neoantigens based on one or more matches between sequence identified in the patients material and a sequence from the sequence listing.

In some more detail, it was realized by the inventor of the present invention that with the human genome being about $3 \times 10^9$ base pairs, about 1.5% of which is coding for protein, the number of possible point-mutations (nucleotide changes or SNVs) is virtually infinite, especially since each position can mutate into three others, and of course endless other rearrangements and indels are possible. Therefore the number of possible neoantigens that arise in tumors is also huge.

A specific window of cancer mutations is derived from the reference human genome sequence. While the $3 \times 10^9$ base pairs can mutate in infinite ways, there is only a limited repertoire of possible neoantigens dictated by the coding (and expressed) part of the human genome sequence. The ORFeome (the complete set of open reading frames (ORFs) in a genome), as it has been referred to, is 'meant' to be read in the proper reading frame. However, there are two other frames of each gene, the −1 and +1. These alternative frames do not necessarily encode relevant peptides, since they may run into a stop triplet fast. The present inventor has defined that part of the genome that encodes peptides resulting from out of frame translation and that are at least the size of a potential epitope when it is seen as a neoantigen. These peptides are referred to as the neo open reading frame peptides, or NOPs. The maximal coding region for each of these NOPs (which we may refer to as pNOP, for potential NOP) begins immediately downstream of a stop triplet in the reference human genome sequence, contains then at least ten amino acid-encoding triplets, and finishes with a stop.

Thus each gene as defined in the reference genome sequence includes a set of pNOPs. These NOPs are commonly not expressed in the human body, and if they were they would therefore be seen by the immune system as entirely foreign. Since, other than SNV-neoantigens, they are not a small change in a known peptide chain, but a longer stretch of foreign amino acid sequence, it is a priori to be expected that these NOPs are seen by the immune system on average as much more foreign and antigenic than SNV-neoantigens.

In the present invention simple insertions and deletions in coding regions are preferred, which—in order to cause a frame shift-could be of any length, but should not have a length that is 3 nucleotides or a multiple of 3 nucleotides, and should not create a novel stop triplet on the spot. Again, the set of such frame shift causing mutations is, like the set of SNV-causing mutations, virtually infinite: at every position in the 1.5% coding region of the genome almost any insertion or deletion (or net result from insertion plus deletion) of net change of sequence of + or − 1, 2, 4, 5, 7, 8 etc. nucleotides could bring a NOP in frame.

According to the invention provided are peptide based vaccines, meaning vaccines comprising the at least two neo out-of-frame peptides selected from SEQ ID Nos 1-4307, or nucleic acid based vaccines comprising a nucleic acid encoding at least two amino acid sequences selected from SEQ ID Nos 1-4307, to be used as personalized cancer vaccines.

A tumor of a patient can be screened for the presence of frame shift mutations, and once found a vaccine comprising the peptide which comprises among others the corresponding NOP can be used to immunize the patient, so the immune system of the patient will target the tumor cells expressing the neo antigen.

Thus, in some embodiments according to the invention, the peptide according to the invention is prepared/comprises at least two, preferably all the NOPs selected from SEQ ID 1-4307 and that have been identified in a cancer patient by screening for the presence of frame shift mutations that caused the NOP, or part thereof, to be encoded in the genome of the cancer cells of that patient. For example, if based on screening of tumor material from the patient, frame-shift mutations are identified in the patient and that encode for amino acid sequence with, for example, SEQ ID NO 1, SEQ ID NO 31, SEQ ID NO 231, and SEQ ID NO 756, the peptide according to the invention comprises at least two, e.g. SEQ ID NO 31 and SEQ ID NO 231, preferably all of these amino acid sequences. Alternatively an isolated nucleic acid may be provided, and that encodes for such peptide. According to this aspect of the invention, a vaccine can be provided that, in one vaccine, e.g. in one peptide or nucleic acid encoding such peptide, comprises all NOPs encoded or expressed in the cancer cells in that patient.

One issue that may arise when considering NOPs as personalized cancer vaccines is that once a tumor from a patient has been sequenced and one (or more) frame shift mutations have been identified, the corresponding NOP (or NOPs) need to be selected from the list of potential NOPS and made in a vaccine. This may be a time consuming process, while time is something the cancer patient usually lacks as the disease progresses. An "off-the-shelf" solution, where each NOP is already available as a vaccine may become available in the future, but it would be beneficial to provide for alternative approaches as well.

According to the invention, it has now surprisingly been found that an "off-the-shelf" (personalized) cancer vaccine can be achieved due to the finding that frame shift mutations in a relatively small number of genes contribute to a large extend to the presence of the total amount frame shift mutations identified in the TCGA patient cohort. This has led to the finding that, by combining multiple NOPs in a single peptide according to the invention (also referred to as polyNOP), with a library of relatively few peptides according to the invention used as vaccines a large percentage of the patients would be covered with a potential vaccine.

Figure 6:
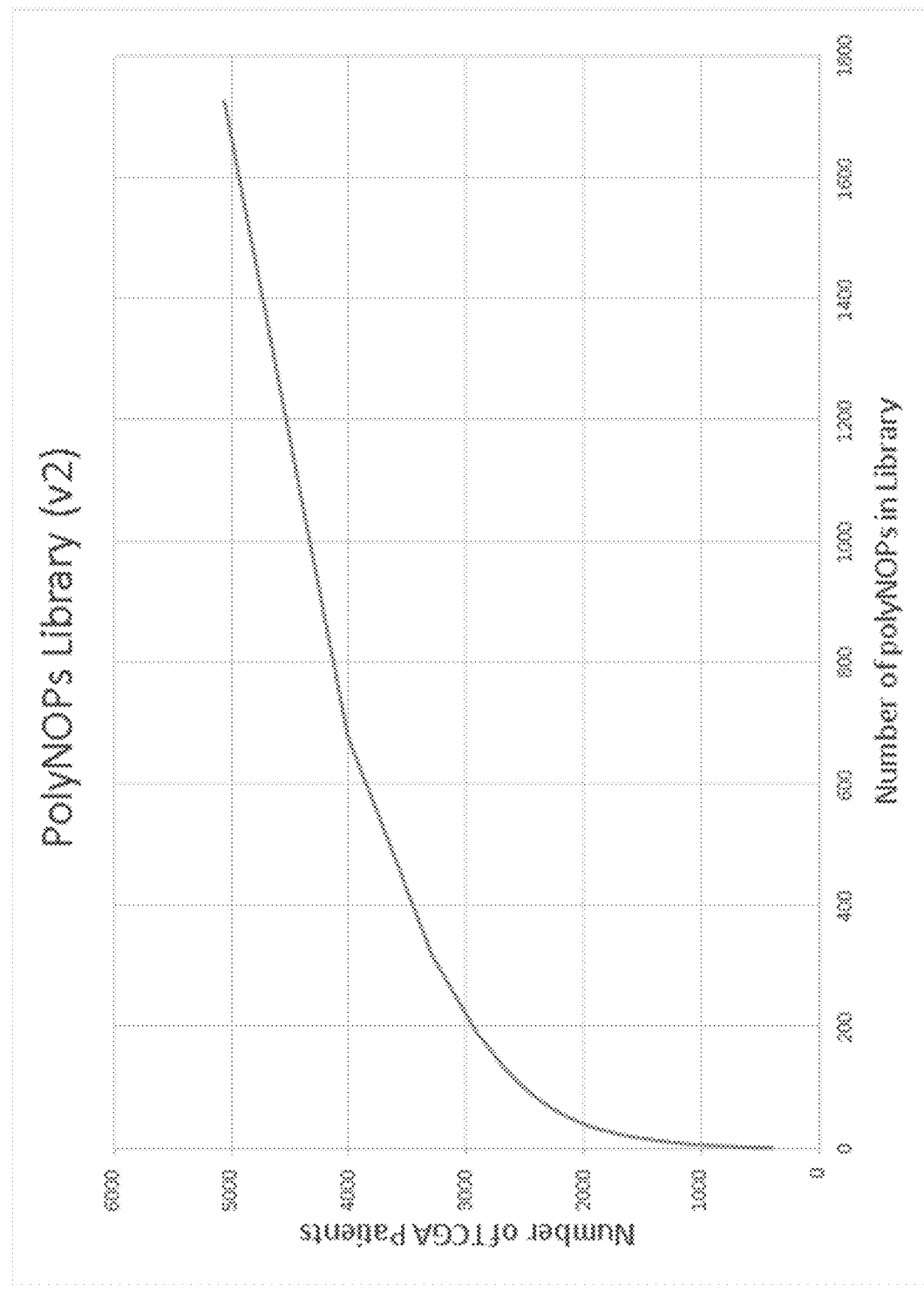
FIG. 6: Graphical representation of the number of patients in the TGCA cohort (https://cancergenome.nih.gov/publications/publicationguidelines) which have a frame shift mutation which is represented by a NOP (SEQ ID 1-4307) present in a library of polyNOP peptides, versus the amount of polyNOP peptides in present in the library. The data presented relates to the situation wherein each (individual) polyNOP covers all candidate NOPs for a single gene (e.g. all sequences of Group 1 or Group 2 or Group 3 . . . . Group 1103), and the polyNOPs are added to the library in order of abundance of frame shift mutations identified in said gene in the TCGA cohort, most frequent identified genes added first.

Table 1 was constructed by the inventor by identifying all genes for which frame shift mutation have been found in at least two separate patients in the TCGA patient cohort, and then sorting this list of genes from most frequently mutated (by frame shifts) to least frequently. Then for each identified frame shift mutation NOPs are identified that overlap with the frame shift mutations identified in the patients for each gene, and all these candidate NOPs are linked together to create a polyNOP for each gene. FIG. 6 presents a graphical representation of the number of patients in the TGCA cohort which have a frame shift mutation which is represented by a NOP (SEQ ID 1-4307) present in a library of polyNOP peptides, versus the amount of polyNOP peptides in present in the library. Using polyNOPs according to the invention for the 6 most frequently frame shifted genes (in tumors of cancer patients in the TCGA cohort), e.g. groups 1-6 in Table 1, the genes TP53 (SEQ ID Nos 1-21), ARID1A (SEQ ID Nos 22-61), KMT2D (SEQ ID Nos 62-100), GATA3 (SEQ ID Nos 101-109), APC (SEQ ID Nos 110-128) and PTEN (SEQ ID Nos 129-143), 10% of the patients in the TCGA would be covered, meaning a vaccine can be created for 10% of cancer patients from a polyNOP library of only 6 polyNOPs. By further extending this library to polyNOPs covering the 200 most frame shifted genes, about 30% of the patient's in the TCGA cohort would be covered.

In a preferred embodiment of the invention the vaccine comprises a peptide (or nucleic acid encoding this peptide) comprising all the candidate NOPs for a single gene, meaning each of the sequences of a group selected form the groups in Table 1. This makes it possible to construct a single vaccine for this gene which would be suitable for any patient which has a frame shift mutation in this gene, regardless of the location or reading frame.

The 1103 most frequently frame shifted genes identified by the above method are listed below in Table 1 together with the SEQ ID Nos representing the NOP peptides which overlap with the frame shift mutations identified in the patients.

TABLE 1

| Group No.: | Gene: | SEQ ID Nos: |
|---|---|---|
| 1 | TP53 | 1-21 |
| 2 | ARID1A | 22-61 |
| 3 | KMT2D | 62-100 |
| 4 | GATA3 | 101-109 |
| 5 | APC | 110-128 |
| 6 | PTEN | 129-143 |
| 7 | ZNF429 | 144-148 |
| 8 | VHL | 149-157 |
| 9 | CIC | 158-175 |
| 10 | ATRX | 176-193 |
| 11 | CDKN2A | 194-199 |
| 12 | PBRM1 | 200-223 |
| 13 | NF1 | 224-244 |
| 14 | RB1 | 245-254 |
| 15 | ZFP36L2 | 255-258 |
| 16 | ZFHX3 | 259-273 |

TABLE 1-continued

| Group No.: | Gene: | SEQ ID Nos: |
|---|---|---|
| 17 | CDH1 | 274-283 |
| 18 | ZFP36L1 | 284-295 |
| 19 | TTN | 296-327 |
| 20 | MAP3K1 | 328-340 |
| 21 | NOTCH1 | 341-354 |
| 22 | BAP1 | 355-364 |
| 23 | RUNX1 | 365-371 |
| 24 | KDM6A | 372-387 |
| 25 | SOX9 | 388-394 |
| 26 | KMT2C | 395-408 |
| 27 | MUC16 | 409-437 |
| 28 | ELF3 | 438-444 |
| 29 | PCLO | 445-461 |
| 30 | TOP2A | 462-468 |
| 31 | STK11 | 469-473 |
| 32 | FOXA1 | 474-479 |
| 33 | PCDHB2 | 480-484 |
| 34 | ARHGAP35 | 485-494 |
| 35 | FAT1 | 495-507 |
| 36 | ZNF750 | 508-512 |
| 37 | PIK3R1 | 513-519 |
| 38 | FLG | 520-556 |
| 39 | KMT2B | 557-571 |
| 40 | ARID2 | 572-580 |
| 41 | ZNF14 | 581-582 |
| 42 | FBN2 | 583-592 |
| 43 | BCOR | 593-600 |
| 44 | CDKN1A | 601-605 |
| 45 | HLA-A | 606-614 |
| 46 | ZNF814 | 615-618 |
| 47 | ARID5B | 619-623 |
| 48 | FBXW7 | 624-630 |
| 49 | CDK12 | 631-639 |
| 50 | AJUBA | 640-644 |
| 51 | TBX3 | 645-652 |
| 52 | CDKN1B | 653-656 |
| 53 | H2AFX | 657-658 |
| 54 | ZNF468 | 659-661 |
| 55 | MBD6 | 662-670 |

TABLE 1-continued

| Group No.: | Gene: | SEQ ID Nos: |
|---|---|---|
| 56 | SETD2 | 671-681 |
| 57 | MUC6 | 682-691 |
| 58 | MUC5B | 692-724 |
| 59 | BRCA2 | 725-734 |
| 60 | TCF12 | 735-744 |
| 61 | APOB | 745-752 |
| 62 | ROBO1 | 753-759 |
| 63 | LRP1B | 760-769 |
| 64 | CREBBP | 770-777 |
| 65 | NCOR2 | 778-789 |
| 66 | RNF43 | 790-798 |
| 67 | ZNF420 | 799-805 |
| 68 | HMCN1 | 806-813 |
| 69 | TLE1 | 814-818 |
| 70 | HOXA3 | 819-824 |
| 71 | AXIN1 | 825-830 |
| 72 | B2M | 831-833 |
| 73 | ASXL1 | 834-836 |
| 74 | NCOR1 | 837-840 |
| 75 | ALB | 841-845 |
| 76 | CSMD2 | 846-850 |
| 77 | ZNF675 | 851-853 |
| 78 | SRCAP | 854-864 |
| 79 | FUBP1 | 865-870 |
| 80 | ARID1B | 871-878 |
| 81 | FAT2 | 879-888 |
| 82 | LRP1 | 889-895 |
| 83 | ABCA13 | 896-904 |
| 84 | TGIF1 | 905-913 |
| 85 | DDX3X | 914-919 |
| 86 | SMAD4 | 920-922 |
| 87 | FOSL2 | 923-924 |
| 88 | HRNR | 925-945 |
| 89 | RANBP2 | 946-957 |
| 90 | JARID2 | 958-967 |
| 91 | YLPM1 | 968-972 |
| 92 | MGA | 973-982 |
| 93 | SPEN | 983-990 |
| 94 | TG | 991-999 |

TABLE 1-continued

| Group No.: | Gene: | SEQ ID Nos: |
|---|---|---|
| 95 | ITGA10 | 1000-1003 |
| 96 | ZMYM3 | 1004-1009 |
| 97 | ACVR2A | 1010-1015 |
| 98 | ZNF658 | 1016-1019 |
| 99 | COL11A1 | 1020-1026 |
| 100 | REV3L | 1027-1034 |
| 101 | CTNND2 | 1035-1040 |
| 102 | PLXNB2 | 1041-1046 |
| 103 | RBM15B | 1047-1050 |
| 104 | KRT5 | 1051-1053 |
| 105 | SELPLG | 1054-1055 |
| 106 | ZNF256 | 1056-1057 |
| 107 | ANKRD11 | 1058-1063 |
| 108 | COL18A1 | 1064-1074 |
| 109 | IRS1 | 1075-1080 |
| 110 | AHNAK2 | 1081-1138 |
| 111 | BCORL1 | 1139-1145 |
| 112 | COL7A1 | 1146-1154 |
| 113 | ZNF534 | 1155-1157 |
| 114 | ADAMTSL1 | 1158-1162 |
| 115 | ROCK2 | 1163-1167 |
| 116 | COL22A1 | 1168-1173 |
| 117 | INVS | 1174-1177 |
| 118 | MUC4 1 | 178-1188 |
| 119 | TNFAIP3 | 1189-1194 |
| 120 | KANSL1 | 1195-1200 |
| 121 | MYO10 | 1201-1204 |
| 122 | SEC63 | 1205-1205 |
| 123 | INPPL1 | 1206-1210 |
| 124 | KMT2A | 1211-1214 |
| 125 | TUBB4A | 1215-1217 |
| 126 | ASXL2 | 1218-1220 |
| 127 | GPS2 | 1221-1223 |
| 128 | OTOF | 1224-1227 |
| 129 | KDM5C | 1228-1231 |
| 130 | PRKARIA | 1232-1233 |
| 131 | ZNF613 | 1234-1235 |
| 132 | KEAP1 | 1236-1238 |
| 133 | ZFHX4 | 1239-1251 |
| 134 | ELMSAN1 | 1252-1258 |
| 135 | BCL9 | 1259-1265 |
| 136 | CACNA1A | 1266-1275 |
| 137 | DNAH5 | 1276-1285 |
| 138 | CUX1 | 1286-1291 |
| 139 | CAMSAP2 | 1292-1296 |
| 140 | NEB | 1297-1310 |
| 141 | RERE | 1311-1317 |
| 142 | TSHZ3 | 1318-1324 |
| 143 | DAZAP1 | 1325-1331 |
| 144 | EP300 | 1332-1337 |
| 145 | GAS2L2 | 1338-1341 |
| 146 | MEN1 | 1342-1345 |
| 147 | PCDHA6 | 1346-1347 |
| 148 | GSE1 | 1348-1352 |
| 149 | HIVEP3 | 1353-1360 |
| 150 | EPHA2 | 1361-1363 |
| 151 | SETD1B | 1364-1369 |
| 152 | KCND2 | 1370-1372 |
| 153 | KMT2E | 1373-1377 |
| 154 | LRRIQ1 | 1378-1381 |
| 155 | PRRC2A | 1382-1385 |
| 156 | RASA1 | 1386-1391 |
| 157 | RBM15 | 1392-1394 |
| 158 | COL11A2 | 1395-1404 |
| 159 | ITPR2 | 1405-1409 |
| 160 | TCF4 | 1410-1413 |
| 161 | TSC1 | 1414-1417 |
| 162 | MYO9B | 1418-1423 |
| 163 | PRKAB1 | 1424-1427 |
| 164 | CTAGE1 | 1428-1428 |
| 165 | PCDHGA11 | 1429-1431 |
| 166 | BCHE | 1432-1434 |
| 167 | CHST2 | 1435-1437 |
| 168 | KAT6B | 1438-1439 |
| 169 | PEG3 | 1440-1444 |
| 170 | FLNC | 1445-1448 |
| 171 | SPTBN2 | 1449-1452 |
| 172 | ALS2 | 1453-1456 |

TABLE 1-continued

| Group No.: | Gene: | SEQ ID Nos: |
|---|---|---|
| 173 | FAH | 1457-1457 |
| 174 | NF2 | 1458-1460 |
| 175 | PTPRC | 1461-1463 |
| 176 | RBM10 | 1464-1468 |
| 177 | TGFBR2 | 1469-1471 |
| 178 | ZNF436 | 1472-1473 |
| 179 | INHBA | 1474-1476 |
| 180 | PLCG1 | 1477-1479 |
| 181 | ADAMTS6 | 1480-1481 |
| 182 | GRIN3A | 1482-1483 |
| 183 | KIF1A | 1484-1485 |
| 184 | ASAH1 | 1486-1487 |
| 185 | BCL2L11 | 1488-1488 |
| 186 | FXR2 | 1489-1490 |
| 187 | RPL5 | 1491-1492 |
| 188 | SALL1 | 1493-1494 |
| 189 | ZFP64 | 1495-1497 |
| 190 | ZNF841 | 1498-1501 |
| 191 | ZNF90 | 1502-1507 |
| 192 | ANK3 | 1508-1515 |
| 193 | ATM | 1516-1524 |
| 194 | TNRC18 | 1525-1531 |
| 195 | ZNF607 | 1532-1533 |
| 196 | KIAA1217 | 1534-1548 |
| 197 | CTCF | 1549-1556 |
| 198 | POTEF | 1557-1561 |
| 199 | TRIOBP | 1562-1569 |
| 200 | ZNF292 | 1570-1577 |
| 201 | CUBN | 1578-1584 |
| 202 | FBN3 | 1585-1590 |
| 203 | KIAA1211 | 1591-1595 |
| 204 | FOXP4 | 1596-1604 |
| 205 | TNS2 | 1605-1607 |
| 206 | IGSF9B | 1608-1614 |
| 207 | PDZD2 | 1615-1619 |
| 208 | UNC79 | 1620-1623 |
| 209 | ZNF549 | 1624-1625 |
| 210 | HNRNPL | 1626-1627 |
| 211 | ARHGAP33 | 1628-1634 |
| 212 | ATP13A3 | 1635-1639 |
| 213 | LMTK3 | 1640-1642 |
| 214 | MEGF8 | 1643-1647 |
| 215 | PRRT2 | 1648-1651 |
| 216 | CHD3 | 1652-1658 |
| 217 | FLNA | 1659-1665 |
| 218 | HECA | 1666-1669 |
| 219 | ATXN2L | 1670-1682 |
| 220 | PCDHGA2 | 1683-1686 |
| 221 | KIAA2026 | 1687-1690 |
| 222 | TRPA1 | 1691-1693 |
| 223 | HMGB1 | 1694-1695 |
| 224 | HOXB3 | 1696-1698 |
| 225 | SZT2 | 1699-1703 |
| 226 | VWF | 1704-1709 |
| 227 | NKX2-2 | 1710-1712 |
| 228 | PRRC2B | 1713-1717 |
| 229 | TAF1C | 1718-1724 |
| 230 | TP53BP1 | 1725-1728 |
| 231 | ZDBF2 | 1729-1732 |
| 232 | CELSR3 | 1733-1737 |
| 233 | MED13 | 1738-1742 |
| 234 | NCOA6 | 1743-1748 |
| 235 | PHF20L1 | 1749-1752 |
| 236 | REPIN1 | 1753-1756 |
| 237 | TECTA | 1757-1761 |
| 238 | TNIK | 1762-1766 |
| 239 | ZNF687 | 1767-1771 |
| 240 | ACVR1B | 1772-1777 |
| 241 | CYP2B6 | 1778-1779 |
| 242 | DLX6 | 1780-1781 |
| 243 | FOXP1 | 1782-1787 |
| 244 | HDGF | 1788-1792 |
| 245 | NBPF10 | 1793-1793 |
| 246 | SCAF4 | 1794-1797 |
| 247 | SMAP1 | 1798-1800 |
| 248 | ADGRB1 | 1801-1802 |
| 249 | ASIC2 | 1803-1806 |
| 250 | MXD3 | 1807-1809 |

TABLE 1-continued

| Group No.: | Gene: | SEQ ID Nos: |
|---|---|---|
| 251 | NBPF9 | 1810-1812 |
| 252 | BRD2 | 1813-1817 |
| 253 | HOXD8 | 1818-1820 |
| 254 | KCNA6 | 1821-1823 |
| 255 | TBC1D10A | 1824-1826 |
| 256 | AARS2 | 1827-1829 |
| 257 | ATP1A2 | 1830-1832 |
| 258 | BCL3 | 1833-1834 |
| 259 | EWSR1 | 1835-1840 |
| 260 | IHH | 1841-1842 |
| 261 | KHSRP | 1843-1846 |
| 262 | MYOF | 1847-1850 |
| 263 | NLGN4X | 1851-1853 |
| 264 | PKHD1 | 1854-1856 |
| 265 | PLEKHA7 | 1857-1860 |
| 266 | RIPK4 | 1861-1864 |
| 267 | SF11 | 1865-1869 |
| 268 | SLC16A10 | 1870-1872 |
| 269 | SUN1 | 1873-1879 |
| 270 | VPS13B | 1880-1882 |
| 271 | ADAMTS5 | 1883-1885 |
| 272 | AFF4 | 1886-1888 |
| 273 | ATF7IP | 1889-1894 |
| 274 | CPEB4 | 1895-1896 |
| 275 | ING5 | 1897-1901 |
| 276 | MAPKBP1 | 1902-1903 |
| 277 | PLXNC1 | 1904-1906 |
| 278 | PTPRZ1 | 1907-1909 |
| 279 | ADAMTS15 | 1910-1912 |
| 280 | APBB1IP | 1913-1915 |
| 281 | BRD7 | 1916-1919 |
| 282 | CA1 | 1920-1920 |
| 283 | DOCK3 | 1921-1923 |
| 284 | GRIN2C | 1924-1925 |
| 285 | IRF7 | 1926-1928 |
| 286 | LRRN2 | 1929-1931 |
| 287 | NEIL1 | 1932-1936 |
| 288 | SLIT2 | 1937-1939 |
| 289 | TRAM1L1 | 1940-1941 |
| 290 | CBLN1 | 1942-1943 |
| 291 | DCLK1 | 1944-1945 |
| 292 | EED | 1946-1947 |
| 293 | GIGYF2 | 1948-1949 |
| 294 | MUC1 | 1950-1950 |
| 295 | NALCN | 1951-1952 |
| 296 | RAD21 | 1953-1954 |
| 297 | ADAL | 1955-1957 |
| 298 | AGL | 1958-1959 |
| 299 | DDIT4 | 1960-1961 |
| 300 | EHD3 | 1962-1963 |
| 301 | FZD5 | 1964-1964 |
| 302 | HES1 | 1965-1966 |
| 303 | LATS1 | 1967-1969 |
| 304 | MYB | 1970-1971 |
| 305 | NSRP1 | 1972-1973 |
| 306 | PLXND1 | 1974-1975 |
| 307 | POM121 | 1976-1977 |
| 308 | SEZ6L | 1978-1979 |
| 309 | SOX10 | 1980-1980 |
| 310 | SPTBN5 | 1981-1982 |
| 311 | ZNF408 | 1983-1984 |
| 312 | ETS2 | 1985-1985 |
| 313 | PCDH17 | 1986-1986 |
| 314 | VCL | 1987-1987 |
| 315 | WT1 | 1988-1988 |
| 316 | WWC3 | 1989-1989 |
| 317 | ZNF208 | 1990-2005 |
| 318 | ZNF43 | 2006-2014 |
| 319 | MAML2 | 2015-2016 |
| 320 | ZNF816 | 2017-2018 |
| 321 | FMN2 | 2019-2024 |
| 322 | ZNF714 | 2025-2026 |
| 323 | BCL9L | 2027-2034 |
| 324 | ZNF469 | 2035-2042 |
| 325 | ALG10 | 2043-2047 |
| 326 | CD93 | 2048-2051 |
| 327 | STAB1 | 2052-2058 |
| 328 | IRF2BPL | 2059-2060 |

TABLE 1-continued

| Group No.: | Gene: | SEQ ID Nos: |
|---|---|---|
| 329 | KDM6B | 2061-2068 |
| 330 | ZNF439 | 2069-2070 |
| 331 | PPIG | 2071-2075 |
| 332 | TET1 | 2076-2081 |
| 333 | DIDO1 | 2082-2086 |
| 334 | RBBP6 | 2087-2093 |
| 335 | SACS | 2094-2100 |
| 336 | KDM2B | 2101-2106 |
| 337 | MPRIP | 2107-2110 |
| 338 | PDS5B | 2111-2114 |
| 339 | BAHCC1 | 2115-2121 |
| 340 | FIGN | 2122-2125 |
| 341 | SLC9A4 | 2126-2129 |
| 342 | ADAMTS2 | 2130-2134 |
| 343 | ROCK1 | 2135-2140 |
| 344 | ZNF776 | 2141-2143 |
| 345 | PSD3 | 2144-2147 |
| 346 | NOS1 | 2148-2152 |
| 347 | ZNF233 | 2153-2153 |
| 348 | ARHGAP17 | 2154-2159 |
| 349 | ASPM | 2160-2167 |
| 350 | FAM214B | 2168-2170 |
| 351 | MAP1A | 2171-2175 |
| 352 | SMARCC2 | 2176-2184 |
| 353 | ARHGEF15 | 2185-2188 |
| 354 | DST | 2189-2192 |
| 355 | HECTD2 | 2193-2194 |
| 356 | HLA-B | 2195-2199 |
| 357 | MYOCD | 2200-2203 |
| 358 | TIE1 | 2204-2207 |
| 359 | WDFY3 | 2208-2211 |
| 360 | ALPK3 | 2212-2214 |
| 361 | DYRK1A | 2215-2217 |
| 362 | HGFAC | 2218-2222 |
| 363 | ITGB4 | 2223-2226 |
| 364 | TET3 | 2227-2230 |
| 365 | TNRC6B | 2231-2234 |
| 366 | ZNF443 | 2235-2237 |
| 367 | ZNF831 | 2238-2241 |
| 368 | AFF2 | 2242-2248 |
| 369 | COL4A1 | 2249-2253 |
| 370 | CTAGE9 | 2254-2256 |
| 371 | EPHB6 | 2257-2260 |
| 372 | GPR158 | 2261-2266 |
| 373 | LAMB1 | 2267-2270 |
| 374 | NOD2 | 2271-2273 |
| 375 | PRDM2 | 2274-2278 |
| 376 | RNF213 | 2279-2283 |
| 377 | TCF7 | 2284-2288 |
| 378 | TDRD5 | 2289-2291 |
| 379 | TRIM46 | 2292-2294 |
| 380 | COL8A1 | 2295-2299 |
| 381 | DMBT1 | 2300-2314 |
| 382 | FOLH1 | 2315-2318 |
| 383 | MIA3 | 2319-2323 |
| 384 | NAB2 | 2324-2327 |
| 385 | PRDM15 | 2328-2333 |
| 386 | TMEM92 | 2334-2335 |
| 387 | WASF3 | 2336-2339 |
| 388 | ZNF395 | 2340-2342 |
| 389 | AGO2 | 2343-2344 |
| 390 | BAG4 | 2345-2346 |
| 391 | COL6A3 | 2347-2352 |
| 392 | EGFLAM | 2353-2356 |
| 393 | EXPH5 | 2357-2360 |
| 394 | HOXA1 | 2361-2364 |
| 395 | INTU | 2365-2366 |
| 396 | MAP3K4 | 2367-2368 |
| 397 | MTA1 | 2369-2370 |
| 398 | MYRF | 2371-2374 |
| 399 | NRIP1 | 2375-2377 |
| 400 | NYAP1 | 2378-2379 |
| 401 | PLXNB1 | 2380-2382 |
| 402 | RTTN | 2383-2385 |
| 403 | SLC27A3 | 2386-2389 |
| 404 | TCF7L2 | 2390-2400 |
| 405 | TMEM184A | 2401-2402 |
| 406 | TOPBP1 | 2403-2404 |

TABLE 1-continued

| Group No.: | Gene: | SEQ ID Nos: |
|---|---|---|
| 407 | ACTN4 | 2405-2407 |
| 408 | COL9A2 | 2408-2411 |
| 409 | IGSF10 | 2412-2415 |
| 410 | JAG2 | 2416-2418 |
| 411 | KDM3B | 2419-2422 |
| 412 | KIAA0556 | 2423-2424 |
| 413 | KLHDC8B | 2425-2427 |
| 414 | MAP3K12 | 2428-2430 |
| 415 | NAV3 | 2431-2434 |
| 416 | NBEA | 2435-2439 |
| 417 | NFAT5 | 2440-2443 |
| 418 | NHLRC2 | 2444-2445 |
| 419 | NHS | 2446-2448 |
| 420 | PKHD1L1 | 2449-2451 |
| 421 | SLC4A2 | 2452-2456 |
| 422 | ADAM28 | 2457-2459 |
| 423 | AKAP9 | 2460-2463 |
| 424 | ARL13B | 2464-2467 |
| 425 | ATP1A1 | 2468-2471 |
| 426 | CAMTA1 | 2472-2474 |
| 427 | GPSM3 | 2475-2476 |
| 428 | HIVEP2 | 2477-2480 |
| 429 | ROS1 | 2481-2484 |
| 430 | SIPA1L2 | 2485-2488 |
| 431 | SLC6A6 | 2489-2490 |
| 432 | SYNE1 | 2491-2494 |
| 433 | TM9SF3 | 2495-2496 |
| 434 | TPR | 2497-2498 |
| 435 | TRIP10 | 2499-2501 |
| 436 | ZNF696 | 2502-2502 |
| 437 | DNMT3A | 2503-2505 |
| 438 | EGR3 | 2506-2507 |
| 439 | ELAC2 | 2508-2511 |
| 440 | ERICH3 | 2512-2515 |
| 441 | FAM98A | 2516-2518 |
| 442 | FBXO38 | 2519-2520 |
| 443 | FOXD4 | 2521-2522 |
| 444 | HSPG2 | 2523-2524 |
| 445 | MNDA | 2525-2526 |
| 446 | MTDH | 2527-2528 |
| 447 | MYH15 | 2529-2531 |
| 448 | NLRP7 | 2532-2535 |
| 449 | NOTCH2 | 2536-2539 |
| 450 | PTPRN | 2540-2544 |
| 451 | SRRM2 | 2545-2548 |
| 452 | TRAF3IP2 | 2549-2551 |
| 453 | AHNAK | 2552-2561 |
| 454 | ANK1 | 2562-2564 |
| 455 | ARHGEF10 | 2565-2570 |
| 456 | BCLAF1 | 2571-2572 |
| 457 | CCDC181 | 2573-2575 |
| 458 | CNOT4 | 2576-2578 |
| 459 | CP | 2579-2580 |
| 460 | DBF4 | 2581-2582 |
| 461 | DISP2 | 2583-2585 |
| 462 | F13A1 | 2586-2588 |
| 463 | FANCB | 2589-2590 |
| 464 | FCGBP | 2591-2595 |
| 465 | GRIK3 | 2596-2598 |
| 466 | NAA25 | 2599-2601 |
| 467 | NFATC2 | 2602-2604 |
| 468 | PTPN14 | 2605-2607 |
| 469 | PTPRB | 2608-2610 |
| 470 | ST6GALNAC3 | 2611-2614 |
| 471 | STAT6 | 2615-2617 |
| 472 | ZNF644 | 2618-2619 |
| 473 | ADGRG1 | 2620-2621 |
| 474 | ANKFY1 | 2622-2623 |
| 475 | BRAP | 2624-2624 |
| 476 | CDX2 | 2625-2626 |
| 477 | CNTLN | 2627-2628 |
| 478 | DOPEY2 | 2629-2630 |
| 479 | GNAZ | 2631-2632 |
| 480 | HDX | 2633-2634 |
| 481 | ITPKB | 2635-2636 |
| 482 | MYOM3 | 2637-2638 |
| 483 | NCAM2 | 2639-2643 |
| 484 | NCKAP5 | 2644-2645 |

TABLE 1-continued

| Group No.: | Gene: | SEQ ID Nos: |
|---|---|---|
| 485 | PCSK5 | 2646-2648 |
| 486 | PLXNA3 | 2649-2650 |
| 487 | RBMX2 | 2651-2652 |
| 488 | RTN1 | 2653-2655 |
| 489 | SCN2A | 2656-2658 |
| 490 | SEZ6L2 | 2659-2661 |
| 491 | SH3D21 | 2662-2664 |
| 492 | SIGLEC10 | 2665-2668 |
| 493 | SLC35G2 | 2669-2670 |
| 494 | SPDEF | 2671-2674 |
| 495 | SRSF11 | 2675-2676 |
| 496 | TAF3 | 2677-2678 |
| 497 | TET2 | 2679-2681 |
| 498 | TP53BP2 | 2682-2684 |
| 499 | UBC | 2685-2694 |
| 500 | ZC3H11A | 2695-2697 |
| 501 | ZFX | 2698-2699 |
| 502 | ACTB | 2700-2701 |
| 503 | AOC2 | 2702-2703 |
| 504 | ARMCX3 | 2704-2705 |
| 505 | ASTN2 | 2706-2707 |
| 506 | CD44 | 2708-2715 |
| 507 | CHEK2 | 2716-2717 |
| 508 | COX10 | 2718-2719 |
| 509 | CUL7 | 2720-2721 |
| 510 | CYP4F2 | 2722-2722 |
| 511 | ENKUR | 2723-2725 |
| 512 | FLCN | 2726-2726 |
| 513 | FOXO4 | 2727-2728 |
| 514 | HDAC4 | 2729-2730 |
| 515 | JUN | 2731-2732 |
| 516 | KCNJ3 | 2733-2734 |
| 517 | MED12 | 2735-2735 |
| 518 | NAA15 | 2736-2737 |
| 519 | P2RY11 | 2738-2739 |
| 520 | PGR | 2740-2741 |
| 521 | PHB | 2742-2743 |
| 522 | PNPLA3 | 2744-2745 |
| 523 | RBM14 | 2746-2747 |
| 524 | RBMX | 2748-2749 |
| 525 | RHBDF1 | 2750-2751 |
| 526 | SCAP | 2752-2753 |
| 527 | SMC4 | 2754-2755 |
| 528 | STK31 | 2756-2757 |
| 529 | SUPT20H | 2758-2760 |
| 530 | TM6SF2 | 2761-2762 |
| 531 | ZNF518B | 2763-2764 |
| 532 | ZNF615 | 2765-2766 |
| 533 | ZNF804A | 2767-2767 |
| 534 | ARID4B | 2768-2769 |
| 535 | BAZ2B | 2770-2771 |
| 536 | C9orf152 | 2772-2772 |
| 537 | CARD6 | 2773-2774 |
| 538 | CBFB | 2775-2775 |
| 539 | CNTNAP1 | 2776-2777 |
| 540 | COG5 | 2778-2779 |
| 541 | COL14A1 | 2780-2781 |
| 542 | CPT1B | 2782-2783 |
| 543 | DBF4B | 2784-2785 |
| 544 | DDX5 | 2786-2786 |
| 545 | DEPDC5 | 2787-2788 |
| 546 | DPY19L2 | 2789-2790 |
| 547 | E2F3 | 2791-2793 |
| 548 | EDNRB | 2794-2795 |
| 549 | EPAS1 | 2796-2797 |
| 550 | FBP1 | 2798-2799 |
| 551 | FBXO15 | 2800-2801 |
| 552 | GOT1 | 2802-2803 |
| 553 | GRAP2 | 2804-2804 |
| 554 | HIST1H1C | 2805-2806 |
| 555 | HNRNPA1 | 2807-2808 |
| 556 | HTR2B | 2809-2810 |
| 557 | HTR3A | 2811-2812 |
| 558 | IGSF1 | 2813-2814 |
| 559 | KCNN2 | 2815-2816 |
| 560 | KHDRBS1 | 2817-2818 |
| 561 | KIF5B | 2819-2820 |
| 562 | MRPS22 | 2821-2821 |

TABLE 1-continued

| Group No.: | Gene: | SEQ ID Nos: |
|---|---|---|
| 563 | MTRR | 2822-2823 |
| 564 | MTUS1 | 2824-2825 |
| 565 | PCDHGA8 | 2826-2827 |
| 566 | PDZRN3 | 2828-2829 |
| 567 | POLM | 2830-2833 |
| 568 | PRDM16 | 2834-2835 |
| 569 | RASSF1 | 2836-2839 |
| 570 | RLIM | 2840-2841 |
| 571 | SYNJ1 | 2842-2844 |
| 572 | TAP2 | 2845-2847 |
| 573 | TFCP2 | 2848-2849 |
| 574 | TMEM100 | 2850-2850 |
| 575 | TRIM15 | 2851-2852 |
| 576 | TRMT112 | 2853-2853 |
| 577 | TROAP | 2854-2856 |
| 578 | UNG | 2857-2858 |
| 579 | VN1R1 | 2859-2859 |
| 580 | ZNF445 | 2860-2861 |
| 581 | ARIH2 | 2862-2863 |
| 582 | COL21A1 | 2864-2864 |
| 583 | DBR1 | 2865-2865 |
| 584 | DESI2 | 2866-2866 |
| 585 | FRMD3 | 2867-2867 |
| 586 | HSPD1 | 2868-2868 |
| 587 | KLK12 | 2869-2872 |
| 588 | MAGEA3 | 2873-2873 |
| 589 | MTBP | 2874-2874 |
| 590 | NCDN | 2875-2875 |
| 591 | P2RY8 | 2876-2876 |
| 592 | PDE4A | 2877-2877 |
| 593 | RBM48 | 2878-2878 |
| 594 | REM2 | 2879-2879 |
| 595 | RSPH1 | 2880-2881 |
| 596 | SEC22A | 2882-2882 |
| 597 | SLC23A1 | 2883-2884 |
| 598 | SPRY2 | 2885-2885 |
| 599 | STK39 | 2886-2886 |
| 600 | TCEAL5 | 2887-2887 |
| 601 | TPBG | 2888-2888 |
| 602 | WAC | 2889-2890 |
| 603 | ACER2 | 2891-2891 |
| 604 | AFTPH | 2892-2892 |
| 605 | AGTR1 | 2893-2893 |
| 606 | ALPP | 2894-2894 |
| 607 | ARFGAP2 | 2895-2896 |
| 608 | ARVCF | 2897-2897 |
| 609 | ATP10B | 2898-2898 |
| 610 | ATP13A1 | 2899-2899 |
| 611 | AURKAIP1 | 2900-2900 |
| 612 | BASP1 | 2901-2901 |
| 613 | BTBD10 | 2902-2902 |
| 614 | CBR1 | 2903-2903 |
| 615 | CD274 | 2904-2904 |
| 616 | CEP68 | 2905-2905 |
| 617 | CYP2R1 | 2906-2906 |
| 618 | DET1 | 2907-2907 |
| 619 | DOCK6 | 2908-2908 |
| 620 | DUSP16 | 2909-2909 |
| 621 | EME1 | 2910-2910 |
| 622 | EP400 | 2911-2911 |
| 623 | ESYT1 | 2912-2912 |
| 624 | FAM227B | 2913-2913 |
| 625 | FBXO45 | 2914-2914 |
| 626 | FTO | 2915-2915 |
| 627 | GOLGA3 | 2916-2916 |
| 628 | GPRC5A | 2917-2917 |
| 629 | HAS3 | 2918-2918 |
| 630 | HHIPL 1 | 2919-2919 |
| 631 | HIPK2 | 2920-2920 |
| 632 | HIST1H4J | 2921-2921 |
| 633 | HMGCL | 2922-2922 |
| 634 | HSPA8 | 2923-2924 |
| 635 | IKZF4 | 2925-2925 |
| 636 | IL1RL1 | 2926-2926 |
| 637 | ISCA1 | 2927-2927 |
| 638 | KCNQ5 | 2928-2928 |
| 639 | KCNT2 | 2929-2929 |
| 640 | KIFC3 | 2930-2930 |

TABLE 1-continued

| Group No.: | Gene: | SEQ ID Nos: |
|---|---|---|
| 641 | KLF15 | 2931-2931 |
| 642 | KLF6 | 2932-2932 |
| 643 | KLHL28 | 2933-2933 |
| 644 | LRRC14 | 2934-2934 |
| 645 | LYST | 2935-2935 |
| 646 | MRPL22 | 2936-2936 |
| 647 | NFAM1 | 2937-2937 |
| 648 | NFIX | 2938-2939 |
| 649 | NONO | 2940-2940 |
| 650 | NPM1 | 2941-2941 |
| 651 | POGZ | 2942-2942 |
| 652 | PTGER4 | 2943-2943 |
| 653 | RGMB | 2944-2944 |
| 654 | RHEBL1 | 2945-2945 |
| 655 | RREB1 | 2946-2946 |
| 656 | RTN3 | 2947-2947 |
| 657 | SLC25A43 | 2948-2948 |
| 658 | SMCR8 | 2949-2949 |
| 659 | SNAI3 | 2950-2950 |
| 660 | SOS1 | 2951-2951 |
| 661 | STEAP4 | 2952-2953 |
| 662 | SYN1 | 2954-2954 |
| 663 | TCFL5 | 2955-2955 |
| 664 | TFAP2A | 2956-2956 |
| 665 | TINF2 | 2957-2957 |
| 666 | TMED1 | 2958-2958 |
| 667 | TMEM120A | 2959-2959 |
| 668 | TOB2 | 2960-2960 |
| 669 | TOM1 | 2961-2962 |
| 670 | TRMT61B | 2963-2963 |
| 671 | TTC16 | 2964-2964 |
| 672 | TUBA1A | 2965-2966 |
| 673 | UBXN1 | 2967-2968 |
| 674 | USH1C | 2969-2969 |
| 675 | UTP3 | 2970-2970 |
| 676 | ZBED2 | 2971-2971 |
| 677 | ZNF628 | 2972-2973 |
| 678 | ZNF141 | 2974-2977 |
| 679 | ZNF761 | 2978-2981 |
| 680 | ZFP3 | 2982-2982 |
| 681 | PTCH1 | 2983-2992 |
| 682 | BTBD7 | 2993-3002 |
| 683 | RAI1 | 3003-3007 |
| 684 | FAM193A | 3008-3012 |
| 685 | ZC3H18 | 3013-3016 |
| 686 | ZNF529 | 3017-3019 |
| 687 | PCDHB4 | 3020-3023 |
| 688 | SYNE2 | 3024-3034 |
| 689 | AXIN2 | 3035-3042 |
| 690 | ITGAX | 3043-3045 |
| 691 | SCN9A | 3046-3052 |
| 692 | C5orf42 | 3053-3059 |
| 693 | JAK1 | 3060-3064 |
| 694 | MECOM | 3065-3069 |
| 695 | MKL1 | 3070-3073 |
| 696 | PNISR | 3074-3079 |
| 697 | POLG | 3080-3081 |
| 698 | TTF1 | 3082-3083 |
| 699 | ANKRD12 | 3084-3086 |
| 700 | CPAMD8 | 3087-3090 |
| 701 | FOXA2 | 3091-3094 |
| 702 | HECTD4 | 3095-3100 |
| 703 | IRX3 | 3101-3104 |
| 704 | PEAR1 | 3105-3108 |
| 705 | ZMYM1 | 3109-3112 |
| 706 | ADNP | 3113-3118 |
| 707 | CASP8 | 3119-3124 |
| 708 | GAS6 | 3125-3127 |
| 709 | HDLBP | 3128-3134 |
| 710 | OBSCN | 3135-3146 |
| 711 | PYGO2 | 3147-3148 |
| 712 | RBM27 | 3149-3150 |
| 713 | SBF1 | 3151-3154 |
| 714 | ZBTB41 | 3155-3157 |
| 715 | ABR | 3158-3163 |
| 716 | BRF1 | 3164-3168 |
| 717 | FOXQ1 | 3169-3171 |
| 718 | GTF3C1 | 3172-3180 |

TABLE 1-continued

| Group No.: | Gene: | SEQ ID Nos: |
|---|---|---|
| 719 | HSPB8 | 3181-3182 |
| 720 | KIAA0100 | 3183-3187 |
| 721 | NAV1 | 3188-3194 |
| 722 | RYR1 | 3195-3200 |
| 723 | SPRED1 | 3201-3203 |
| 724 | TSPYL2 | 3204-3205 |
| 725 | ZNF677 | 3206-3207 |
| 726 | ATP10D | 3208-3211 |
| 727 | DLGAP3 | 3212-3214 |
| 728 | ERG | 3215-3219 |
| 729 | KCNH4 | 3220-3223 |
| 730 | ULK2 | 3224-3226 |
| 731 | COL4A2 | 3227-3231 |
| 732 | DYSF | 3232-3236 |
| 733 | FHDC1 | 3237-3239 |
| 734 | GDF5 | 3240-3242 |
| 735 | MDN1 | 3243-3246 |
| 736 | NOTCH3 | 3247-3250 |
| 737 | PCDHB13 | 3251-3253 |
| 738 | PCDHB14 | 3254-3256 |
| 739 | PCDHB3 | 3257-3259 |
| 740 | POLR2A | 3260-3263 |
| 741 | PPP6R2 | 3264-3267 |
| 742 | RAE1 | 3268-3270 |
| 743 | RP1L1 | 3271-3278 |
| 744 | TACC2 | 3279-3283 |
| 745 | WRN | 3284-3287 |
| 746 | ARMCX5-GPRASP2 | 3288-3292 |
| 747 | ATN1 | 3293-3296 |
| 748 | C1orf112 | 3297-3298 |
| 749 | CHD1 | 3299-3302 |
| 750 | CLGN | 3303-3306 |
| 751 | DNAH6 | 3307-3310 |
| 752 | KNOP1 | 3311-3314 |
| 753 | LTBP4 | 3315-3317 |
| 754 | MAML3 | 3318-3318 |
| 755 | MED23 | 3319-3322 |
| 756 | MSH3 | 3323-3326 |
| 757 | RING1 | 3327-3329 |
| 758 | SETBP1 | 3330-3334 |
| 759 | UBR5 | 3335-3337 |
| 760 | ZNF484 | 3338-3340 |
| 761 | ZNF541 | 3341-3344 |
| 762 | ZNF627 | 3345-3346 |
| 763 | ABCB1 | 3347-3349 |
| 764 | AKAP12 | 3350-3353 |
| 765 | BSN | 3354-3359 |
| 766 | BTRC | 3360-3361 |
| 767 | CHD8 | 3362-3366 |
| 768 | COPA | 3367-3369 |
| 769 | DENND4B | 3370-3371 |
| 770 | DNAH10 | 3372-3376 |
| 771 | KIDINS220 | 3377-3380 |
| 772 | MARK2 | 3381-3390 |
| 773 | MTSS1 | 3391-3395 |
| 774 | NBEAL1 | 3396-3398 |
| 775 | NYNRIN | 3399-3403 |
| 776 | OAS2 | 3404-3406 |
| 777 | PHF21A | 3407-3410 |
| 778 | PRPF40A | 3411-3414 |
| 779 | PRTG | 3415-3416 |
| 780 | ROBO2 | 3417-3421 |
| 781 | RPRD2 | 3422-3423 |
| 782 | SCAF1 | 3424-3426 |
| 783 | TCOF1 | 3427-3431 |
| 784 | XRCC2 | 3432-3433 |
| 785 | ZNF177 | 3434-3436 |
| 786 | ZNF790 | 3437-3438 |
| 787 | ADGRA2 | 3439-3441 |
| 788 | CASD1 | 3442-3445 |
| 789 | EPHA4 | 3446-3448 |
| 790 | FAS | 3449-3450 |
| 791 | FOXN2 | 3451-3454 |
| 792 | FXR1 | 3455-3457 |
| 793 | HNF1A | 3458-3459 |
| 794 | LARP1 | 3460-3463 |
| 795 | MAP3K11 | 3464-3466 |
| 796 | MKI67 | 3467-3468 |

TABLE 1-continued

| Group No.: | Gene: | SEQ ID Nos: |
|---|---|---|
| 797 | NSD1 | 3469-3473 |
| 798 | PTCH2 | 3474-3476 |
| 799 | SHANK2 | 3477-3481 |
| 800 | UBR4 | 3482-3483 |
| 801 | XRN1 | 3484-3485 |
| 802 | ZNF670 | 3486-3486 |
| 803 | ZNF780A | 3487-3490 |
| 804 | ALCAM | 3491-3492 |
| 805 | ASAP2 | 3493-3495 |
| 806 | CLUH | 3496-3498 |
| 807 | FIGNL1 | 3499-3500 |
| 808 | GRIK2 | 3501-3504 |
| 809 | HDAC2 | 3505-3507 |
| 810 | HELZ2 | 3508-3510 |
| 811 | HERC2 | 3511-3514 |
| 812 | IL7R | 3515-3515 |
| 813 | JAG1 | 3516-3519 |
| 814 | PDZD4 | 3520-3526 |
| 815 | PLOD3 | 3527-3528 |
| 816 | PSD2 | 3529-3531 |
| 817 | RASA2 | 3532-3533 |
| 818 | RFC1 | 3534-3537 |
| 819 | RNF217 | 3538-3540 |
| 820 | SLITRK2 | 3541-3544 |
| 821 | ST6GALNAC5 | 3545-3548 |
| 822 | SYCP2 | 3549-3551 |
| 823 | TRIP12 | 3552-3553 |
| 824 | UGT1A9 | 3554-3555 |
| 825 | AHDC1 | 3556-3559 |
| 826 | C21orf59-TCP10L | 3560-3561 |
| 827 | CBX8 | 3562-3562 |
| 828 | COL1A2 | 3563-3565 |
| 829 | DSCAML1 | 3566-3569 |
| 830 | EHBP1 | 3570-3573 |
| 831 | FRAS1 | 3574-3577 |
| 832 | GIGYF1 | 3578-3579 |
| 833 | GRB14 | 3580-3581 |
| 834 | HSF4 | 3582-3584 |
| 835 | IFIH1 | 3585-3587 |
| 836 | JADE1 | 3588-3589 |
| 837 | KIF21A | 3590-3593 |
| 838 | LAMC3 | 3594-3595 |
| 839 | LOC107987545 | 3596-3596 |
| 840 | MED12L | 3597-3601 |
| 841 | MEX3B | 3602-3603 |
| 842 | MYO15A | 3604-3605 |
| 843 | PSMC4 | 3606-3608 |
| 844 | RBM33 | 3609-3612 |
| 845 | RBPJ | 3613-3615 |
| 846 | SCRIB | 3616-3616 |
| 847 | SEMA5B | 3617-3621 |
| 848 | SENP6 | 3622-3623 |
| 849 | TAF15 | 3624-3626 |
| 850 | TUBGCP6 | 3627-3631 |
| 851 | UGT1A1 | 3632-3632 |
| 852 | WDR44 | 3633-3635 |
| 853 | YBX2 | 3636-3636 |
| 854 | ZBED4 | 3637-3638 |
| 855 | ZHX2 | 3639-3642 |
| 856 | ZRANB2 | 3643-3644 |
| 857 | AHCTF1 | 3645-3647 |
| 858 | BRD1 | 3648-3652 |
| 859 | C19orf47 | 3653-3654 |
| 860 | CCAR1 | 3655-3657 |
| 861 | CCDC120 | 3658-3661 |
| 862 | CERK | 3662-3663 |
| 863 | COBLL1 | 3664-3665 |
| 864 | COL16A1 | 3666-3667 |
| 865 | COL17A1 | 3668-3670 |
| 866 | DCLK3 | 3671-3671 |
| 867 | DDR1 | 3672-3675 |
| 868 | DNAJC1 | 3676-3678 |
| 869 | DROSHA | 3679-3682 |
| 870 | EGR1 | 3683-3684 |
| 871 | ENTPD2 | 3685-3685 |
| 872 | ETV1 | 3686-3690 |
| 873 | FILIP1L | 3691-3692 |
| 874 | GBE1 | 3693-3694 |

TABLE 1-continued

| Group No.: | Gene: | SEQ ID Nos: |
|---|---|---|
| 875 | GGNBP2 | 3695-3696 |
| 876 | HP1BP3 | 3697-3698 |
| 877 | IGF2R | 3699-3700 |
| 878 | ITSN1 | 3701-3705 |
| 879 | KIAA0391 | 3706-3708 |
| 880 | LAMP3 | 3709-3710 |
| 881 | LILRB5 | 3711-3714 |
| 882 | LTBR | 3715-3718 |
| 883 | MAP1B | 3719-3722 |
| 884 | MAST2 | 3723-3725 |
| 885 | MICALL2 | 3726-3727 |
| 886 | MRPS5 | 3728-3729 |
| 887 | NEK1 | 3730-3732 |
| 888 | NUP214 | 3733-3735 |
| 889 | PHLPP1 | 3736-3736 |
| 890 | PLEKHM1 | 3737-3737 |
| 891 | PRG4 | 3738-3740 |
| 892 | PSME4 | 3741-3743 |
| 893 | RAPH1 | 3744-3746 |
| 894 | RNF25 | 3747-3748 |
| 895 | RYR3 | 3749-3752 |
| 896 | SAP130 | 3753-3758 |
| 897 | SENP7 | 3759-3760 |
| 898 | SLC12A7 | 3761-3763 |
| 899 | SMARCA1 | 3764-3766 |
| 900 | SOCS3 | 3767-3768 |
| 901 | SPEF2 | 3769-3772 |
| 902 | TBCK | 3773-3774 |
| 903 | TJP2 | 3775-3779 |
| 904 | TNKS | 3780-3781 |
| 905 | TNRC6C | 3782-3784 |
| 906 | TNS3 | 3785-3788 |
| 907 | WDFY4 | 3789-3791 |
| 908 | ZBTB20 | 3792-3793 |
| 909 | ZC3H12B | 3794-3797 |
| 910 | ZNF212 | 3798-3798 |
| 911 | ZNF318 | 3799-3802 |
| 912 | ABCA5 | 3803-3805 |
| 913 | ADAMTSL2 | 3806-3808 |
| 914 | ALDOB | 3809-3811 |
| 915 | ATAD2 | 3812-3814 |
| 916 | BDP1 | 3815-3817 |
| 917 | BTAF1 | 3818-3819 |
| 918 | C1QA | 3820-3820 |
| 919 | CDHR2 | 3821-3822 |
| 920 | CENPF | 3823-3824 |
| 921 | CEP162 | 3825-3826 |
| 922 | CHD9 | 3827-3830 |
| 923 | CIR1 | 3831-3832 |
| 924 | CLCA4 | 3833-3834 |
| 925 | CLCN3 | 3835-3838 |
| 926 | CNTNAP3 | 3839-3840 |
| 927 | COL15A1 | 3841-3843 |
| 928 | CUL9 | 3844-3846 |
| 929 | DCX | 3847-3853 |
| 930 | EPB41L3 | 3854-3857 |
| 931 | EPN2 | 3858-3859 |
| 932 | FAM168B | 3860-3861 |
| 933 | FCHO2 | 3862-3863 |
| 934 | GLI1 | 3864-3865 |
| 935 | GLIS1 | 3866-3867 |
| 936 | GLYR1 | 3868-3871 |
| 937 | HEPACAM2 | 3872-3874 |
| 938 | HERC1 | 3875-3877 |
| 939 | HERC3 | 3878-3879 |
| 940 | HHIP | 3880-3882 |
| 941 | INF2 | 3883-3887 |
| 942 | KCNH2 | 3888-3889 |
| 943 | KIAA1324L | 3890-3891 |
| 944 | MED25 | 3892-3894 |
| 945 | MKRN3 | 3895-3896 |
| 946 | NCOA3 | 3897-3898 |
| 947 | OSM | 3899-3900 |
| 948 | PAPLN | 3901-3904 |
| 949 | PCDHB12 | 3905-3906 |
| 950 | PHGR1 | 3907-3907 |
| 951 | PPP2R5B | 3908-3910 |
| 952 | SEC24C | 3911-3913 |

TABLE 1-continued

| Group No.: | Gene: | SEQ ID Nos: |
|---|---|---|
| 953 | SMC3 | 3914-3915 |
| 954 | SMC6 | 3916-3918 |
| 955 | SPATA2L | 3919-3920 |
| 956 | SPG7 | 3921-3923 |
| 957 | STAU2 | 3924-3926 |
| 958 | STON1 | 3927-3929 |
| 959 | TNKS1BP1 | 3930-3933 |
| 960 | TNRC6A | 3934-3935 |
| 961 | ZBTB22 | 3936-3938 |
| 962 | ZKSCAN4 | 3939-3940 |
| 963 | ZNF609 | 3941-3943 |
| 964 | ADAMTS9 | 3944-3946 |
| 965 | ANKRD36 | 3947-3952 |
| 966 | ANXA11 | 3953-3955 |
| 967 | ARHGAP30 | 3956-3958 |
| 968 | ATL1 | 3959-3959 |
| 969 | BMP2K | 3960-3961 |
| 970 | C19orf44 | 3962-3963 |
| 971 | CASKIN2 | 3964-3965 |
| 972 | CDH13 | 3966-3968 |
| 973 | CIITA | 3969-3970 |
| 974 | CSF1 | 3971-3973 |
| 975 | ESPL1 | 3974-3976 |
| 976 | ESPNL | 3977-3978 |
| 977 | EYA1 | 3979-3983 |
| 978 | FRMD4A | 3984-3986 |
| 979 | GBP1 | 3987-3989 |
| 980 | GTPBP10 | 3990-3990 |
| 981 | HCFC2 | 3991-3993 |
| 982 | HOXD3 | 3994-3996 |
| 983 | IL21R | 3997-3999 |
| 984 | KAT5 | 4000-4003 |
| 985 | KDM5B | 4004-4005 |
| 986 | KIAA0825 | 4006-4007 |
| 987 | KLHL36 | 4008-4010 |
| 988 | LRP2 | 4011-4013 |
| 989 | LTN1 | 4014-4016 |
| 990 | MAGED1 | 4017-4019 |
| 991 | MED13L | 4020-4021 |
| 992 | MGAT5 | 4022-4022 |
| 993 | MMP10 | 4023-4024 |
| 994 | MMP12 | 4025-4026 |
| 995 | MRPL12 | 4027-4028 |
| 996 | MSLN | 4029-4030 |
| 997 | N4BP2 | 4031-4033 |
| 998 | NAALADL1 | 4034-4036 |
| 999 | NCAM1 | 4037-4039 |
| 1000 | NRROS | 4040-4042 |
| 1001 | PCDHGB4 | 4043-4045 |
| 1002 | PER1 | 4046-4048 |
| 1003 | PLEC | 4049-4059 |
| 1004 | PLEKHG2 | 4060-4063 |
| 1005 | RAB40C | 4064-4064 |
| 1006 | REXO1 | 4065-4066 |
| 1007 | RPS6KA4 | 4067-4068 |
| 1008 | SEC31A | 4069-4071 |
| 1009 | SH2B1 | 4072-4073 |
| 1010 | SH3D19 | 4074-4077 |
| 1011 | SIGLEC9 | 4078-4080 |
| 1012 | SLC16A12 | 4081-4081 |
| 1013 | SLC38A3 | 4082-4084 |
| 1014 | SMARCAD1 | 4085-4087 |
| 1015 | SNX18 | 4088-4089 |
| 1016 | SQLE | 4090-4090 |
| 1017 | SREK1 | 4091-4092 |
| 1018 | SUPT5H | 4093-4094 |
| 1019 | SYDE1 | 4095-4098 |
| 1020 | TBC1D10C | 4099-4100 |
| 1021 | TEX1 4 | 4101-4103 |
| 1022 | TMEM161B | 4104-4106 |
| 1023 | TRIM41 | 4107-4109 |
| 1024 | USP40 | 4110-4111 |
| 1025 | ZNF432 | 4112-4113 |
| 1026 | ABCA12 | 4114-4116 |
| 1027 | ABCC9 | 4117-4119 |
| 1028 | ADAMTS18 | 4120-4121 |
| 1029 | AKAP6 | 4122-4123 |
| 1030 | ASAP1 | 4124-4125 |

TABLE 1-continued

| Group No.: | Gene: | SEQ ID Nos: |
|---|---|---|
| 1031 | BAHD1 | 4126-4127 |
| 1032 | CCDC148 | 4128-4128 |
| 1033 | CCDC30 | 4129-4130 |
| 1034 | CD22 | 4131-4133 |
| 1035 | CDK13 | 4134-4136 |
| 1036 | CMYA5 | 4137-4137 |
| 1037 | COL6A6 | 4138-4140 |
| 1038 | CPVL | 4141-4141 |
| 1039 | CTNND1 | 4142-4145 |
| 1040 | DACT1 | 4146-4147 |
| 1041 | DCHS2 | 4148-4150 |
| 1042 | DHX15 | 4151-4153 |
| 1043 | DSP | 4154-4155 |
| 1044 | EPHA1 | 4156-4157 |
| 1045 | ERBB3 | 4158-4160 |
| 1046 | EVPL | 4161-4163 |
| 1047 | FAM160A2 | 4164-4165 |
| 1048 | FBXL19 | 4166-4167 |
| 1049 | FGGY | 4168-4168 |
| 1050 | FOXC2 | 4169-4169 |
| 1051 | GAS2L1 | 4170-4172 |
| 1052 | GPR37 | 4173-4174 |
| 1053 | HNRNPM | 4175-4176 |
| 1054 | HTATSF1 | 4177-4178 |
| 1055 | IARS2 | 4179-4181 |
| 1056 | IFI16 | 4182-4183 |
| 1057 | IFNAR1 | 4184-4185 |
| 1058 | IGSF8 | 4186-4188 |
| 1059 | IREB2 | 4189-4191 |
| 1060 | JAK3 | 4192-4192 |
| 1061 | KCNA3 | 4193-4194 |
| 1062 | LARP4B | 4195-4198 |
| 1063 | LENG9 | 4199-4200 |
| 1064 | LRRC8E | 4201-4204 |
| 1065 | MDM1 | 4205-4207 |
| 1066 | MNX1 | 4208-4208 |
| 1067 | NFATC4 | 4209-4214 |
| 1068 | NUMA1 | 4215-4217 |
| 1069 | PATZ1 | 4218-4219 |
| 1070 | PCNT | 4220-4222 |
| 1071 | PDLIM4 | 4223-4224 |
| 1072 | PHTF2 | 4225-4227 |
| 1073 | PLEKHA4 | 4228-4231 |
| 1074 | POR | 4232-4233 |
| 1075 | POSTN | 4234-4236 |
| 1076 | PRKCA | 4237-4239 |
| 1077 | PRPF40B | 4240-4242 |
| 1078 | PRUNE2 | 4243-4246 |
| 1079 | RALGAPA1 | 4247-4248 |
| 1080 | RBM12B | 4249-4250 |
| 1081 | SDK1 | 4251-4253 |
| 1082 | SHROOM2 | 4254-4255 |
| 1083 | SLC12A9 | 4256-4261 |
| 1084 | SLC4A5 | 4262-4262 |
| 1085 | SLC9B2 | 4263-4264 |
| 1086 | SLIT1 | 4265-4266 |
| 1087 | SPOCD1 | 4267-4269 |
| 1088 | SREBF2 | 4270-4271 |
| 1089 | TFDP2 | 4272-4273 |
| 1090 | TRIM27 | 4274-4276 |
| 1091 | TTLL4 | 4277-4279 |
| 1092 | UHRF1BP1 | 4280-4282 |
| 1093 | USP36 | 4283-4285 |
| 1094 | UTP14C | 4286-4288 |
| 1095 | VARS | 4289-4290 |
| 1096 | WDR81 | 4291-4292 |
| 1097 | ZDHHC8 | 4293-4295 |
| 1098 | ZKSCAN1 | 4296-4297 |
| 1099 | ZNF155 | 4298-4298 |
| 1100 | ZNF337 | 4299-4300 |
| 1101 | ZNF48 | 4301-4302 |
| 1102 | ZNF507 | 4303-4305 |
| 1103 | ZNF672 | 4306-4307 |

It is to be noted that the tumors in the TCGA are of different people, with different disease (one will be a Caucasian with a glioblastoma, the other of Japanese descent with a colon cancer) but they have one thing in common: they have cancer. That means that with the funneling effect described above a vaccine for many different tumors in different people can be provided by combining multiple NOPs in a single peptide according to the invention.

In summary, the present invention is based on the surprising finding that despite the fact that there are infinite possibilities for frame shift mutations in the human genome, a vaccine can be developed that targets a frame shift mutation in a tumor with potential use in a large population of cancer patients. This can be done by combining multiple NOPs in a single peptide. Doing so would allow for "off-the-shelf" personalized vaccines.

Peptides according to the invention comprising of polyNOPs or nucleic acids encoding such, when used as a vaccine, provide the following advantages:

a vaccine constructed from a single polyNOP, as opposed to single NOP, can benefit a large number of patients. For example, a polyNOP comprising multiple NOPs for a single gene as listed in Table 1, wherein the polyNOP comprises for example two or more or each sequence listed for the gene in Table 1, makes the polyNOP suitable for many more patients having a frame shift mutation in the gene. In case each sequence as listed in Table 1 for a gene is included the polyNOP would cover all frame shift mutations for that gene as identified in the TCGA patient cohort. Therefore such a polyNOP (comprising each sequence listed in Table 1 for a single gene (group)), would cover any frame shift mutation for said gene, as opposed to vaccines based on single NOPs, in which case for each frame shift mutation the corresponding NOP needs to be elected, which could be the same NOP but more likely is not. This makes it feasible to construct and/or test the polyNOP in advance and have the vaccine available off-the-shelf. This greatly reduces the time from screening a tumor from a patient to administering a potential vaccine for said tumor to the patient, as it eliminates the time of production, testing and approval. For example, the tumor of a cancer patient is sequenced and reveals a frame shift mutation in a certain gene. The polyNOP vaccine according to this invention and for this respective gene can now be administered to the patient, because the vaccine was already constructed and tested it is available immediately. For example, in case the patients comprises a frame shift mutation in gene KMT2D (group 3 in Table 1) causing the expressing of a NOP, it can be provided with a vaccine according to the invention that is based on two or more, preferably all of SEQ ID Nos 62-100, representing the NOPs for said gene. The same vaccine is available for a further patient that also comprises a frame shift mutation in KMT2D causing the expression of a NOP, even if the mutation is different from the mutation of the first patient, for example the mutation is at another location in the same gene or is an indel that is larger or smaller, or is an indel of same size, but causing a codon for a different amino acid.

a vaccine library of polyNOP based vaccines can be constructed for the most frequently frame shifted genes (in tumors). The added advantage of such library is that in case multiple frame shift mutations are identified in a tumor from a patient, a combination of polyNOP based vaccines can be administered, thereby increasing the likelihood that an immune response is raised against the tumor. An additional advantage is that with a library of limited size a relatively large percentage of patients can be covered with a potential vaccine.

Generally speaking and in one embodiment, the workflow for providing an antigenic peptide for use in an immunogenic composition is as follows. When a patient is diagnosed with a cancer for example a biopsy may be taken from the tumor, or a sample set is taken of the tumor after resection. The genome, exome or transcriptome is sequenced by existing methods. The outcome is compared, for example using a web interface or software, to the polyNOP library. This will identify and display hits. In turn a patient and/or physician can, if they desire, be informed whether or not hits have been found. On average this is expected for up to 30% of the cases.

In its broadest sense there is provided for a peptide comprising at least two amino acid sequences, wherein each of said amino acid sequence is independently selected from the group consisting of SEQ ID Nos 1 to 4307. Sequences 1-4307 in the sequence listing each represent potential NOPs which have also been identified in the tumors of cancer patients in the TCGA cohort, meaning they are the longest possible NOPs that correspond with the NOPs which are expressed due to a frame shift in these patients.

By combining multiple amino acid sequences selected from the group consisting of SEQ ID Nos 1 to 4307, in one and the same peptide, the amount of potential patients that could be treated is increased. Therefore it is disclosed herein that any at least two amino acid sequences may be selected from the group consisting of SEQ ID Nos 1 to 4307 in order to increase the amount of potential patients that may be treated according to the current invention. For example, from the group consisting of SEQ ID Nos 1 to 4307, those amino acid amino acid sequences may be selected to correspond to those genomic regions that are most frequently hit by a frameshift mutation causing the expression of the NOPs are discussed herein. According to the invention it is however preferred to select for each peptide amino acid sequences belonging to the same gene (meaning sequences selected from the same group as listed in Table 1), or alternatively create a combination of the amino acid sequences selected from SEQ ID Nos 1-4307 covering the area's most frequently hit by frame shift mutations.

Combining at least two sequences would increase the potential pool of patients that could be treated by a peptide according to the invention, however it may be beneficial to construct the peptide according to the invention with more sequences selected from the group consisting of SEQ ID Nos 1 to 4307, for example using 3, 4, 5, 6, 7, 8, 9, 10, or more sequences.

The term "independently selected" should be interpreted as that the at least two sequences selected are not the same sequence.

The skilled person is aware that naturally variations may occur in the genome resulting in variation in proteins encoded by the human exome. It is therefore considered that a amino acid sequence may have at least 90% sequence homology with a sequence selected from the group consisting of SEQ ID Nos 1 to 4307, preferably 91%, 92%, 93%, 94%, 95%, 96%, 97%, 98% or 99%, most preferably 100% sequence homology. Likewise, preferably the full length sequences as listed are used in the construction of the peptide according to the invention, however for practical considerations it may be possible to truncate the sequences for various reasons for example in order to prevent redundancy (i.e. to prevent the presence of more than one stretch of amino acids with (near) identical amino acid sequence, and wherein such stretch comprises at least 5, 6, 7, 8 or more amino acids). Therefore it is also disclosed herein that in some embodiments, the peptide according to the invention can be constructed with amino acid sequences each independently having 80%, 81%, 82%, 83%, 84%, 85%, 86%, 87%, 88%, 98%, 90%, 91%, 92%, 93%, 94%, 95%, 96%, 97%, 98% or 99%, most preferably 100% of the length of sequences selected from the group consisting of SEQ ID Nos 1 to 4307.

It is to be noted that the amino acid sequences selected from the group consisting of SEQ ID Nos 1 to 4307 may be included in the peptide in any order, therefore the order is not limited to, for example, the order in which the different amino acid sequences appear in Table 1, or the order in which the corresponding NOPs appear in a protein. For example, in case the peptide according to the invention would comprise two or more of the SEQ ID Nos 973-982 (Group 92 in Table 1, the MGA gene), for example, would comprise SEQ ID NO 973, 977 and 982, these amino acid sequences may be present in the peptide according to the invention, for example, in the order 973-977-982, but also, for example, 977-973-982 or 982-973-977 or any other order, In some preferred embodiments each of said amino acid sequences in the peptide according to the invention is independently selected from the sequences of one group selected from the groups 1 to 1103 as listed in Table 1.

Figure 3:
FIG. 3: Graphical representation of the selection of candidate NOPs for a single identified frame shift mutation in a tumor of a cancer patient. The top bar represents a normal protein sequence, below that is a representation of the protein encoded in the tumor, where the frame shift mutation results in a neo open reading frame (in grey) until a stop codon is encountered. Below that are all potential NOP sequences for this protein, meaning all amino acid sequences that can be expressed in the +1 and −1 reading frames. Overlapping NOPs are selected by taking those NOPs which have corresponding nucleotide sequences with the area surrounding the frame shift location but in a different reading frame, as indicated with the dashed line (in this case NOP 3 for the +1 reading frame and NOP 7 for the −1 reading frame). Overlapping NOPs are then combined to form a single peptide, the individual NOP sequences are either directly linked or linked through an amino acid linker sequence.
Figure 3:
Figure 3:
Figure 3:

Table 1 lists NOPs which overlap with frame shift mutations identified in tumors of cancer patients, and represent a set of the most frequent encountered frame shift mutations. For example FIG. 3 provides a visual example of a protein, and a protein containing a NOP resulting from a frame shift in a patient. Below are visualized all the potential NOPs that could be encoded by the +1 and -1 reading frame. The NOPs indicated with the dashed line are said to overlap, they are the longest possible NOPs that either include the NOP sequence found in the patient or include an amino acid sequence encoded by the alternative reading frame. For example the NOP found in the patient is in the +1 reading frame, the longest potential NOP that contains the same sequence is NOP 3, the corresponding NOP in the alternative reading frame (-1) is NOP 7, as it is encoded by the same nucleotide sequence but in the alternative reading frame (chosen from the frame shifted reading frames +1 and -1).

The list in Table 1 is sorted per gene (groups) and then sorted from genes in which most frequently a frame shift mutation is identified to less frequent. The sequence mentioned per group (e.g. SEQ ID NO 110-128 for group 5 (the gene APC) are NOPs identified for said gene. According to the invention, in a preferred embodiment, it is beneficial to construct the peptide according to the invention based on amino acid sequences from table 1 and derived from the same gene (i.e. from one group as identified in Table 1, for example and preferably 2, 3, 4, 5, 6, 7, 8, 9, or 10 or more sequences from the same group and representing a single gene.

It is however not excluded that amino acid sequences from other genes (i.e. groups in Table 1) are still included in the peptide according to the invention, and/or in case a gene (group in Table 1) is only represented by a few amino acid sequences. It may be combined with amino acid sequences of another gene, for example, because it is also represented by only a few sequences.

In some preferred embodiment the number of amino acid sequences selected from the one group selected from the groups 1 to 1103 are (X-Y) sequences, wherein X represents the total number of sequences in the selected group and Y represents an integer with a value ranging from 0 to (X-2).

The amount of sequences being (X-Y) sequences, wherein X represents the total number of sequences in the selected group and Y represents an integer with a value ranging from 0 to (X-2), selected from one group selected from the groups 1 to 1103 means that at least two sequences are selected from the same group (e.g Group 1 in Table 1), up to and including each of the sequences in said group *e.g. Group 1). For example if the group comprises 10 sequences, 2, 3, 4, 5, 6, 7, 8, 9, or 10 sequences may be selected.

In a preferred embodiment the peptide comprises all of the amino acid sequences listed in Table 1 for the selected group. For example in case group 1 is selected (gene TP53) the peptide comprises each of the sequences with SEQ ID Nos 1-21.

In some preferred embodiment said amino acid sequences comprised in the peptide according to the invention are directly adjacent to each other in the peptide, and/or between said amino acid sequences a linker amino acid sequence may be present. Preferably n between each of said amino acid sequences in the peptide according to the invention linker amino acid sequence is present. Preferably wherein said linker amino acid sequences, independently, have a length of 1, 2, 3, 4 or 5, or more amino acids.

It is disclosed herein that in the peptide according to the invention the amino acid sequences (e.g. those selected from SEQ ID NO 1-4307) may either be directly linked to each other or that they may be linked through linker amino acid sequences.

The use of linker amino acid sequences may be beneficial for example for introducing, among others, signal peptides or cleavage sites. Therefore each connection of the amino acid sequences (e.g. those selected from SEQ ID NO. 1-4307) in the peptide according to the invention may independently be either a direct link of the amino acid sequences (i.e. no linker amino acid sequence, no additional amino acids are present) or an indirect link through a linker amino acid sequence.

In some preferred embodiment at least one, preferably all of the linker amino acid sequences have the amino acid sequence VDD.

Also provided for is an isolated nucleic acid comprising a nucleotide sequence encoding the peptide according to the invention.

It is disclosed herein that both peptide and nucleotide based vaccines are suitable to achieve the effect of the invention. The skilled person will be capable of constructing a nucleic acid with a nucleotide sequence encoding the peptide as described herein using standard codon usage. For example, the nucleic acid having the desired nucleotide sequence can be constructed de novo. As will be understood any other and different codon usage can be implemented.

TABLE 2 most frequently used codon for each amino acid and most frequently used stop codon.

| | |
|---|---|
| A | GCC |
| C | TGC |
| D | GAC |
| E | GAG |
| F | TTC |
| G | GGC |
| H | CAC |
| I | ATC |
| K | AAG |

TABLE 2-continued most frequently used codon for each amino acid and most frequently used stop codon.

| | |
|---|---|
| L | CTG |
| M | ATG |
| N | AAC |
| P | CCC |
| Q | CAG |
| R | CGG |
| S | AGC |
| T | ACC |
| V | GTG |
| W | TGG |
| Y | TAC |
| Stop | TGA |

In some preferred embodiment in said isolated nucleic acid at least 50%, 60%, 70%, 80%, 90%, or 100% of the amino acids in the peptide are encoded by a codon corresponding to a codon presented in Table 2.

Table 2 lists for each acid amino acid (and the stop codon) the most frequently used codon as encountered in the human exome.

It is found that there are several advantages to using the most frequently used codons as listed in Table 2.

First of all it increases the likelihood of the peptide being expressed well. Second, by using different codons, for example using the codons of Table 2, the nucleotide sequence of the nucleic acid according to the invention, and in particular those parts of the nucleic acid that encode for the amino acid sequences comprised in the peptide according to the invention are distinct from the nucleotide sequence as these will be found in the genome of the patient having a frameshift mutation that causes the expression of a NOP as described herein. In other words, the nucleic acid still includes nucleotide sequence that encodes for such NOP, but these nucleotide sequences are different from the corresponding nucleotide sequences as found in a particular patient. If in the nucleic acid according to the invention a further, and undesired, frameshift mutation occurs, this will never cause for the expression of the wild-type protein (or part thereof) because of the changed codon usage.

With at least 50%, 60%, 70%, 80%, 90%, or 100% of the amino acids in the peptide are encoded by a codon corresponding to a codon presented in Table 2 is meant that at least 50%, 60%, 70%, 80%, 90%, or 100% of the codons used in the peptide encoding nucleotide sequence are codons selected from Table 2.

In some preferred embodiment in said isolated nucleic acid, if a linker amino acid sequence is present in the peptide encoded by the nucleic acid, each nucleotide sequence in the nucleic acid that encodes a linker amino acid sequence individually comprises at least one codon triplet, wherein the at least one codon triplet is chosen such that it codes for a stop codon when in the nucleic acid a frame shift occurs upstream of said out of frame stop codon, preferably wherein said codon triplet is chosen from the group consisting of: ATA, CTA, GTA, TTA, ATG, CTG, GTG, TTG, AAA, AAC, AAG, AAT, AGA, AGC, AGG, AGT, GAA, GAC, GAG, and GAT. These codons do not code for a stop codon, but could create a stop codon in case of a frame shift, such as when read in the +1, +2, +4, +, 5, etc. reading frame. For example, two amino acid encoding sequences are linked by a linker amino acid encoding sequence as follows (linker amino acid encoding sequence in bold):

CTATACAGGCGAATGAGATTATG

Resulting in the following amino acid sequence (amino acid linker sequence in bold):

LYRRMRL

In case of a +1 frame shift, the following sequence is encoded:

YTGE[stop]DY

As can be seen, the amino acid linker encoding sequence results in a stop codon.

An additional advantage may be presented by including out of frame stop codons in the sequences encoding the linker amino acid sequences in the peptide. In case a frame shift occurs in the nucleotide sequence encoding the peptide such out of frame stop codon ensures that the reading frame is terminated.

In some preferred embodiments in said isolated nucleic acid the linker amino acid sequences are encoded by the nucleotide sequence GTAGATGAC.

In a most preferred embodiment, the linker amino acid sequences are encoded by the nucleotide sequence GTAGATGAC, as it harbors two out of frame stop codons (TAG and TGA), one in the +1 and one in the −1 reading frame. The amino acid sequence encoded by this nucleotide sequence is VDD. The added advantage of using a nucleotide sequence encoding for this linker amino acid sequence is that any frame shift will result in a stop codon, wherein frame shift is defined as a shift in the sequence resulting in a new open reading frame.

Also provided for is a vector comprising an isolated nucleic acid according to the invention.

Vectors, including plasmid vectors, eukaryotic viral vectors and expression vectors are known to the skilled person. Vectors may be used to express a recombinant gene construct in eukaryotic cells depending on the preference and judgment of the skilled practitioner (see, for example, Sambrook et al., Chapter 16). For example, many viral vectors are known in the art including, for example, retroviruses, adeno-associated viruses, and adenoviruses. Other viruses useful for introduction of a gene into a cell include, but a not limited to, herpes virus, mumps virus, poliovirus, Sindbis virus, and vaccinia virus, such as, canary pox virus. The methods for producing replication-deficient viral particles and for manipulating the viral genomes are well known.

Also provided for is an expression vector comprising a promoter operably linked to an isolated nucleic acid according to the invention.

The nucleotide sequences of the present invention can be contained in an expression vector. An "expression vector" is a DNA element, often of circular structure, having the ability to replicate autonomously in a desired host cell, or to integrate into a host cell genome and also possessing certain well-known features which, for example, permit expression of a coding DNA inserted into the vector sequence at the proper site and in proper orientation. Such features can include, but are not limited to, one or more promoter sequences to direct transcription initiation of the coding DNA and other DNA elements such as enhancers, polyadenylation sites and the like, all as well known in the art.

The expression vector can also be an RNA element that contains the sequences required to initiate translation in the desired reading frame, and possibly additional elements that are known to stabilize or contribute to replicate the RNA molecules after administration. Therefore when used herein the term DNA when referring to an isolated nucleic acid encoding the peptide according to the invention should be interpreted as referring to DNA from which the peptide can be transcribed or RNA molecules from which the peptide can be translated.

Also provided for is a host cell comprising an isolated nucleic acid according to the invention, or a vector according to the invention or an expression vector according to the invention.

The DNA or RNA construct of the present invention may be introduced into a cell (prokaryotic or eukaryotic) by standard methods. As used herein, the terms "transformation" and "transfection" are intended to refer to a variety of art recognized techniques to introduce a DNA into a host cell. Such methods include, for example, transfection, including, but not limited to, liposome-polybrene, DEAE dextran-mediated transfection, electroporation, calcium phosphate precipitation, microinjection, or velocity driven microprojectiles ("biolistics"). Such techniques are well known by one skilled in the art. See, Sambrook et al. (1989) Molecular Cloning: A Laboratory Manual (2 ed. Cold Spring Harbor Lab Press, Plainview, N.Y.). Alternatively, one could use a system that delivers the DNA construct in a gene delivery vehicle. The gene delivery vehicle may be viral or chemical. Various viral gene delivery vehicles can be used with the present invention. In general, viral vectors are composed of viral particles derived from naturally occurring viruses. The naturally occurring virus has been genetically modified to be replication defective and does not generate additional infectious viruses, or it may be a virus that is known to be attenuated and does not have unacceptable side effects.

Also provided for is a vaccine comprising the peptide according to the invention, or the isolated nucleic acid according to the invention, or the vector according to the invention, or the expression vector according to the invention, optionally further comprising a pharmaceutically acceptable excipient.

In some embodiments, the vaccine comprises a pharmaceutically acceptable excipient and/or an adjuvant. The compositions may contain pharmaceutically acceptable auxiliary substances as required to approximate physiological conditions, such as pH adjusting and buffering agents, tonicity adjusting agents, wetting agents and the like. Suitable adjuvants are well-known in the art and include but are not limited to, aluminum (or a salt thereof, e.g., aluminium phosphate and aluminium hydroxide), monophosphoryl lipid A, squalene (e.g., MF59), montanide, hiltonol, poly-ICLC (polyriboinosinic-polyribocytidylic acid-polylysine carboxymethylcellulose), liposomes (e.g. CAF09, cationic adjuvant formulation 09), Amplivant, Resiquimod, Iscomatrix and cytosine phosphoguanine (CpG). A skilled person is able to determine the appropriate adjuvant, if necessary, and an immune-effective amount thereof. As used herein, an immune-effective amount of adjuvant refers to the amount needed to increase the vaccine's immunogenicity in order to achieve the desired effect.

Also disclosed herein, the immunogenic composition or vaccine is capable of raising a specific T-cell response. The vaccine composition comprises either peptides or isolated nucleic acid as described herein. A person skilled in the art can, when desired, select preferred peptides or isolated nucleic acid by testing, for example, the generation of T-cells in vitro as well as their efficiency and overall presence, the proliferation, affinity and expansion of certain T-cells for certain peptides, and the functionality of the T-cells, e.g. by analyzing the IFN-γ production or tumor killing by T-cells. However this is not required, given that the peptides according to the invention are in their entirety foreign to the body and thus potentially highly antigenic.

Also provided for is the vaccine according to the invention for use in the prevention or treatment of a disease, preferably wherein said disease is cancer.

The vaccine according to the invention can be administered alone or in combination with other therapeutic agents. The therapeutic agent is for example, a chemotherapeutic agent, radiation, or immunotherapy. Any suitable therapeutic treatment r a particular, cancer may be administered. Examples of chemotherapeutic agents include, but are not limited to bleomycin, capecitabine, carboplatin, cisplatin, cyclophosphamide, docetaxel, doxorubicin, etoposide, interferon alpha, irinotecan, lansoprazole, levamisole, methotrexate, metoclopramide, mitomycin, omeprazole, ondansetron, paclitaxel, pilocarpine, rituxitnab, tamoxifen, taxol, trastuzumab, vinblastine, and vinorelbine tartrate.

The subject may, in some embodiments, be further administered an anti-immunosuppressive/immunostimulatory agent. For example, the subject is further administered an anti-CTLA antibody or anti-PD-1 or anti-PD-L1. Blockade of CTLA-4 or PD-L1 by antibodies can enhance the immune response to cancerous cells in the patient. In particular, CTLA-4 blockade has been shown effective when following a vaccination protocol.

The optimum amount of each peptide to be included in the vaccine composition and the optimum dosing regimen can be determined by one skilled in the art without undue experimentation. The composition may be prepared for injection of the peptide, DNA or RNA encoding the peptide, or any other carrier comprising such (such as a virus or liposomes). For example, doses of between 1 and 500 mg 50 µg and 1.5 mg, preferably 125 µg to 500 µg, of peptide or DNA may be given and will depend from the respective peptide or DNA. Other methods of administration of the immunogenic compositions are known to the skilled person.

The vaccine may be prepared so that the selection, number and/or amount of peptides present in the composition is patient-specific. Selection of one or more peptides is based on sequencing information from the tumor of the patient. For any frame shift mutation found a corresponding NOP is selected, in which case the polyNOP according to the invention is selected for the vaccine. In case multiple frame shift mutations are found, multiple polyNOPs with corresponding NOPs may be selected for the vaccine. For example, in the tumor of a patient two frame shift mutations were identified, in the genes PTEN and VHL. The polyNOPs comprising SEQ ID NOS 129-143 (PTEN) and the polyNOP comprising the SEQ ID Nos 149-157 (VHL) can be selected for this patient. The selection may also be dependent on the specific type of cancer, the status of the disease, earlier treatment regimens, the immune status of the patient, and, HLA-haplotype of the patient. Furthermore, the vaccine can contain individualized components, according to personal needs of the particular patient.

In therapeutic applications, vaccines are administered to a patient in an amount sufficient to elicit an effective CTL response to the tumor antigen and to cure or at least partially arrest symptoms and/or complications. An amount adequate to accomplish this is defined as "therapeutically effective dose."

For therapeutic use, administration should preferably begin at or shortly after the detection or surgical removal of tumors. This is followed by boosting doses until at least symptoms are substantially abated and for a period thereafter. For that reason being able to provide the immunogenic composition off-the-shelf or in a short period of time is very important. Preferably, the immunogenic compositions are administered parenterally, e.g., intravenously, subcutaneously, intradermally, intramuscularly, or otherwise. The compositions may contain pharmaceutically acceptable auxiliary substances as required to approximate physiological conditions, such as pH adjusting and buffering agents, tonicity adjusting agents, wetting agents and the like.

For therapeutic purposes, nucleic acids encoding a peptide and optionally one or more of the peptides described herein can also be administered to the patient. Thus a vaccine can comprise multiple isolated nucleic acids as described herein. For example a vaccine can comprise an isolated nucleic acid encoding the sequences of group 2 (gene is ARID1A, SEQ ID Nos 22-61), an isolated nucleic acid encoding the sequences of group 4 (gene is GATA3, SEQ ID Nos 101-109) and an isolated nucleic acid encoding the sequences of group 9 (gene is CIC, SEQ ID Nos 158-175). A number of methods are conveniently used to deliver the nucleic acids to the patient. For instance, the nucleic acid can be delivered directly, as "naked DNA". The peptides and polypeptides can also be expressed by attenuated viral hosts, such as vaccinia or fowlpox. This approach involves the use of vaccinia virus as a vector to express nucleotide sequences that encode the peptide. Upon introduction into the subject the recombinant vaccinia virus expresses the peptide according to the invention, and thereby elicits a host CTL response. Vaccinia vectors and methods useful in immunization protocols are described in, e.g., U.S. Pat. No. 4,722,848. Another vector is BCG (Bacille Calmette Guerin) as described in Stover et al. (Nature 351:456-460 (1991)).

Also provided for is a library comprising 2, 3, 4, 5, 6, 7, 8, 9, 10, 20, 30, or more vaccines according to the invention, each vaccine individually comprising at least two, preferably all, amino acid sequences selected from a group selected from the groups 1-1103 as listed in Table 1, or a nucleotide sequence encoding said amino acid sequences, and wherein said 2, 3, 4, 5, 6, 7, 8, 9, 10, 20, 30, or more vaccines each comprise amino acid sequences, or nucleotide sequences encoding said amino acid sequences, from a different group selected from the groups of sequences listed in Table 1. For example, a library may comprise a first vaccine comprising a peptide with 2 or more sequences selected from group 6 of Table 1 or an isolated nucleic acid encoding such peptide, a second vaccine comprising a peptide with 2 or more sequences selected from group 23 of Table 1 or an isolated nucleic acid encoding such peptide, and a third vaccine comprising a peptide with 2 or more sequences selected from group 78 of Table 1 or an isolated nucleic acid encoding such peptide.

A particular advantage is to construct a library of vaccines according to the invention, as it substantially increases the potential of a suitable vaccine being available for a patient wherein a frame shift mutation has been identified in the tumor DNA or RNA. For example, if vaccines are constructed comprising each sequence of one group of Table 1 (i.e. a first vaccine comprising a peptide comprising each of the SEQ ID Nos 1-21 of group 1, or the isolated nucleic acid encoding such peptide, a second vaccine comprising a peptide comprising each of the SEQ ID Nos 176-193 of group 10, or the isolated nucleic acid encoding such peptide), a third vaccine comprising a peptide comprising each of the SEQ ID Nos 245-254 of group 14, or the isolated nucleic acid encoding such peptide)), by constructing a library of these vaccines representing the first 6 groups, a potential vaccine is available for 10% of the patients represented by the TCGA patient cohort.

In some preferred embodiment said library of 2, 3, 4, 5, 6, 7, 8, 9, 10, 20, 30, or more vaccines comprises vaccines each individually comprising at least two, preferably all, amino acid sequences selected from a group selected from the groups 1 to 2, 1 to 3, 1 to 4, 1 to 5, 1 to 6, 1 to 7, 1 to 8, 1 to 9, 1 to 10, 1 to 20, 1 to 30, or 1 to more selected from the groups of sequences listed in Table 1, or nucleotide sequences encoding said amino acid sequences. For example, the library comprises a first vaccine comprising a peptide with two or more sequences form group 1, a second vaccine comprising a peptide with two or more sequences from group 2, a third vaccine with a peptide comprising two or more sequences from group 3 and a fourth vaccine comprising a peptide with two or more sequences from group 4.

When used herein groups 1 to 2 means 1 up to and including 2, groups 1 to 3 mean up to and including 3, etc. Furthermore "1 to more" is used to represent the option when "more" is chosen as the number of vaccine (meaning, more than 30, so for example 31), and is meant to represent the groups 1 up to and including the number representing the number of vaccines selected for the library. In a particularly preferred embodiment, the library comprises 200 vaccines according to the invention, said 200 vaccines comprises sequences selected from groups 1 to 200 selected from the groups of sequences listed in Table 1, or nucleotide sequences encoding said amino acid sequences. For example, the library comprises a vaccine 1 comprising a peptide with at least 2 preferably all of the sequences of group 1, and a vaccine 2 comprising a peptide with at least 2 preferably all of the sequences of group 2, and a vaccine 3 comprising a peptide with at least 2 preferably all of the sequences of group 3, and . . . , and a vaccine 200 comprising a peptide with at least 2 preferably all of the sequences of group 200.

Also provided for is a method for generating a nucleic acid coding for a peptide, the method comprising the steps of:

a) identifying frame shift mutations in the tumor DNA and/or RNA of a cohort of cancer patients in order to obtain a frame shift library;

b) identifying at least one gene which is changed by a frame shift mutation in the tumor DNA and/or RNA of one or more patients in the cohort of cancer patients to obtain a frame shift gene;

c) identifying each novel open reading frame in both the +1 and −1 reading frame that overlaps with or is adjacent to the frame shift location of the frame shifted gene to obtain candidate novel open reading frame sequences;

d) optionally when present, identifying each novel open reading frames in both the +1 and −1 reading frame that overlaps with or is adjacent to the frame shift location for each alternative splicing construct of the frame shift gene to obtain candidate novel alternative splicing open reading frame sequences;

e) combining each of the candidate open reading frame sequences and optionally the candidate novel alternative splicing open reading frame sequences of the frame shift gene in a nucleic acid construct.

Identification of frame shift mutations can be done by sequencing of RNA or DNA using methods known to the skilled person. Sequencing of the genome, exome or transcriptome may be complete, targeted or partial. In some embodiments the sequencing is complete (whole sequencing). In some embodiments the sequencing is targeted. With targeted sequencing is meant that purposively certain region or portion of the genome, exome or transcriptome are sequenced. For example targeted sequencing may be directed to only sequencing for sequences in the set of sequences obtained from the cancer patient that would provide for a match with one or more of the sequences in the sequence listing, for example by using specific primers. In some embodiment only portion of the genome, exome or transcriptome is sequenced. The skilled person is well-aware of methods that allow for whole, targeted or partial sequencing of the genome, exome or transcriptome of a tumor sample of a patient.

For example any suitable sequencing-by-synthesis platform can be used including the Genome Sequencers from Roche/454 Life Sciences, the 1G Analyzer from Illumina/Solexa, the SOLID system from Applied BioSystems, and the Heliscope system from Helicos Biosciences. The method of sequencing the genome, exome or transcriptome is not in particular limited within the context of the present invention.

In some preferred embodiments the genome is sequenced. In some preferred embodiments the exome is sequenced. In some preferred embodiments the transcriptome is sequenced. Preferably the transcriptome is sequenced, in particular the mRNA present in a sample from a tumor of the patient. The transcriptome is representative of genes and neo open reading frame peptides as defined herein being expressed in the tumor in the patient.

Following sequencing of the tumor, using any sequencing method known in the art, the tumor sequences are aligned and compared to a reference genome. Sequence comparison can be performed by any suitable means available to the skilled person. Indeed the skilled person is well equipped with methods to perform such comparison, for example using software tools like BLAST and the like, or specific software to align short or long sequence reads, accurate or noisy sequence reads to a reference genome, e.g. the human reference genome GRCh37 or GRCh38. A match is identified when a sequence identified in the patients material and a sequence as disclosed herein have a string, i.e. a peptide sequence (or RNA or DNA sequence encoding such peptide (sequence) in case the comparison is on the level of RNA or DNA) in common representative of at least 8, preferably at least 10 adjacent amino acids. Furthermore, sequence reads derived from a patients cancer genome (or transcriptome) can partially match the genomic DNA sequences encoding the amino acid sequences as disclosed herein, for example if such sequence reads are derived from exon/intron boundaries or exon/exon junctions, or if part of the sequence aligns upstream (to the 5' end of the gene) of the position of a frameshift mutation. Analysis of sequence reads and identification of frameshift mutations and their protein products will occur through standard methods in the field. For sequence alignment, aligners specific for short or long reads can be used, e.g. BWA (Li and Durbin, Bioinformatics. 2009 Jul. 15; 25 (14): 1754-60) or Minimap2 (Li, Bioinformatics. 2018 Sep. 15; 34 (18): 3094-3100). Subsequently, frameshift mutations can be derived from the read alignments and their comparison to a reference genome sequence (e.g. the human reference genome GRCh37) using variant calling tools, for example Genome Analysis ToolKit (GATK), and the like (McKenna et al. Genome Res. 2010 September; 20 (9): 1297-303). The out-of-frame protein products (NOPs) resulting from frameshift mutations can be identified following the genetic triplet code known in the field and a database of reference sequences as publicly available through e.g. Ensembl, UCSC, NCBI or other sequence resources.

Preferably in step c) only the novel open reading frame is identified which corresponds to the same reading frame as the frame shift mutation identified in the patient that overlaps with or is adjacent to the frame shift location of the frame shifted gene to obtain candidate novel open reading frame sequences; Step d) can optionally be performed in case alternative splice constructs exist which overlap with the frame shift location, meaning the alternative splice construct would also be affected by the frame shift.

For practical reasons first a nucleic acid construct is generated, even if a peptide based vaccine is disclosed herein, however it is also disclosed herein that a peptide is directly synthesized in step e) based on the preceding steps. Therefore, alternatively step e) comprises combining each of the amino acid sequences encoded by the candidate open reading frame sequences and optionally by the candidate novel alternative splicing open reading frame sequences of the frame shift gene in a peptide.

In some preferred embodiment, in the method according to the invention multiple frame shift genes are identified in step b), and wherein candidate novel open reading frame sequences in step c), and optionally candidate novel alternative splicing open reading frame sequences in step d), for each of the frame shift genes identified in step b) are identified, and wherein the candidate open reading frame sequences and optionally the obtained candidate novel alternative splicing open reading frame sequences of the frame shift genes are combined in a single nucleotide construct or in separate nucleotide constructs for each frame shift gene.

In a preferred embodiment in step b) at least one gene is identified which is changed by a frame shift mutation in the tumor DNA and/or RNA of two or more patients in the cohort of cancer patients to obtain a frame shift gene.

In some preferred embodiment, in the method according to the invention, if candidate novel alternative splicing open reading frame sequences are identified, step e) further includes the step of reducing the amount of redundant overlapping sequence between corresponding candidate novel open reading frame sequences and candidate novel alternative splicing open reading frame sequences prior to combining the sequences in a nucleotide construct.

In some preferred embodiment, in the method according to the invention, in the combining of the sequences in step e) the sequences are directly linked adjacent to each other, or wherein between said sequences a linker nucleotide sequence may be present, preferably wherein between each of said sequences a linker nucleotide sequence is present, more preferably wherein said linker nucleotide sequences, independently, have a length of 3, 6, 9, 12 or 15 nucleotides, most preferably wherein each of said linker sequences has the nucleotide sequence GTAGATGAC.

The DNA and/or RNA for sequencing is preferably obtained by taking a sample from a tumor of the patient. The skilled person knowns how to obtain samples from a tumor of a patient and depending on the nature, for example location or size, of the tumor. Preferably the tumor is a solid tumor. Preferably the sample is obtained from the patient by biopsy or resection. The sample is obtained in such manner that is allows for sequencing of the genetic material obtained therein. In order to prevent a less accurate identification of at least one antigen, preferably the sequence of the tumor sample obtained from the patient is compared to the sequence of other non-tumor tissue of the patient, usually blood, obtained by known techniques (e.g. venipuncture).

Comparing of at least one sequence or portion thereof (i.e. part of the at least one sequence, preferably wherein the part is representative of at least 8 or 10 amino acids) from the set of sequences and a (DNA, RNA or peptide) sequence in the database can be done by any suitable mean available to the skilled person. Indeed the skilled person is well equipped with method to perform such comparison, for example using software tools like BLAST and the like.

Alternatively, a method is provided for generating a nucleic acid coding for a peptide, the method comprising the steps of:
  a) identifying frame shift mutations in the tumor DNA and/or RNA of a cohort of cancer patients in order to obtain a frame shift library;
  b) identifying at least two genes which are changed by a frame shift mutation in the tumor DNA and/or RNA of one or more patients in the cohort of cancer patients to obtain a frame shift gene;
  c) identifying each novel open reading frame in both the +1 and −1 reading frame that overlaps with or is adjacent to the frame shift location of the frame shifted gene to obtain candidate novel open reading frame sequences;
  d) optionally when present, identifying each novel open reading frames in both the +1 and −1 reading frame that overlaps with or is adjacent to the frame shift location for each alternative splicing construct of the frame shift gene to obtain candidate novel alternative splicing open reading frame sequences;
  e) combining at least two of the candidate open reading frame sequences and optionally the candidate novel alternative splicing open reading frame sequences of different frame shift genes in a nucleic acid construct.

In a preferred embodiment in step b) at least two genes are identified which are changed by a frame shift mutation in the tumor DNA and/or RNA of two or more patients in the cohort of cancer patients to obtain a frame shift gene.

Preferably in step c) only the novel open reading frame is identified which corresponds to the same reading frame as the frame shift mutation identified in the patient that overlaps with or is adjacent to the frame shift location of the frame shifted gene to obtain candidate novel open reading frame sequences;

Preferences, particularities and considerations expressed herein in the context of any other embodiment likewise apply to the above embodiment.

Indeed, it will be understood that all details, embodiments and preferences discussed with respect to one aspect of embodiment of the invention is likewise applicable to any other aspect or embodiment of the invention and that there is therefore not need to detail all such details, embodiments and preferences for all aspect separately.

Having now generally described the invention, the same will be more readily understood through reference to the following examples which is provided by way of illustration and is not intended to be limiting of the present invention. Further aspects and embodiments will be apparent to those skilled in the art.

EXAMPLES

The NEO-ORFeome is defined as all peptides encoded by the human genome that can be translated from +1 or −1 frame shifts of the coding sequences for all reference sequences (NCBI RefSeqs). These are named proto novel open reading frame peptides or pNOPs. Encountered STOP codons define borders or the translation products (ends a peptide and initiates a new one on the next amino acid)

The length of the translated peptide is ideally 10 or more amino acids. All isoforms are considered separately (every splice-variant).

From the NEO ORFeome, only pNOP regions that overlap with frame-shift mutations (n=2 or more) as defined in the TCGA cohort (n=10,186 patients spanning 33 cancer types) are considered, and selected. A visual representation is given in FIG. 3.

Figure 4:
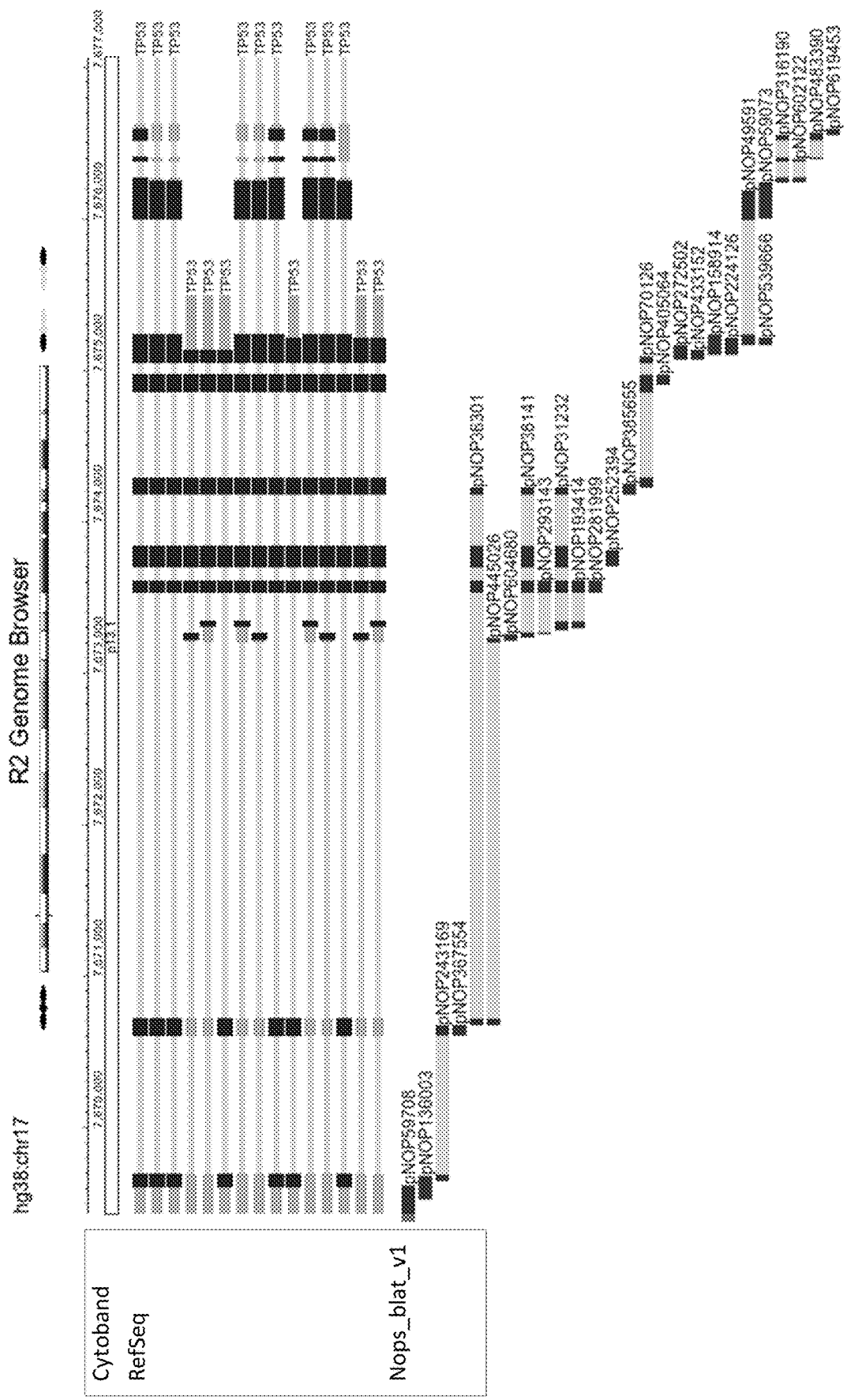
FIG. 4: Example graphical representation of for the splice variants of the gene TP53. The reference sequence (wild type, without mutations) is graphically displayed, together with alternative splice products.
Figure 5:
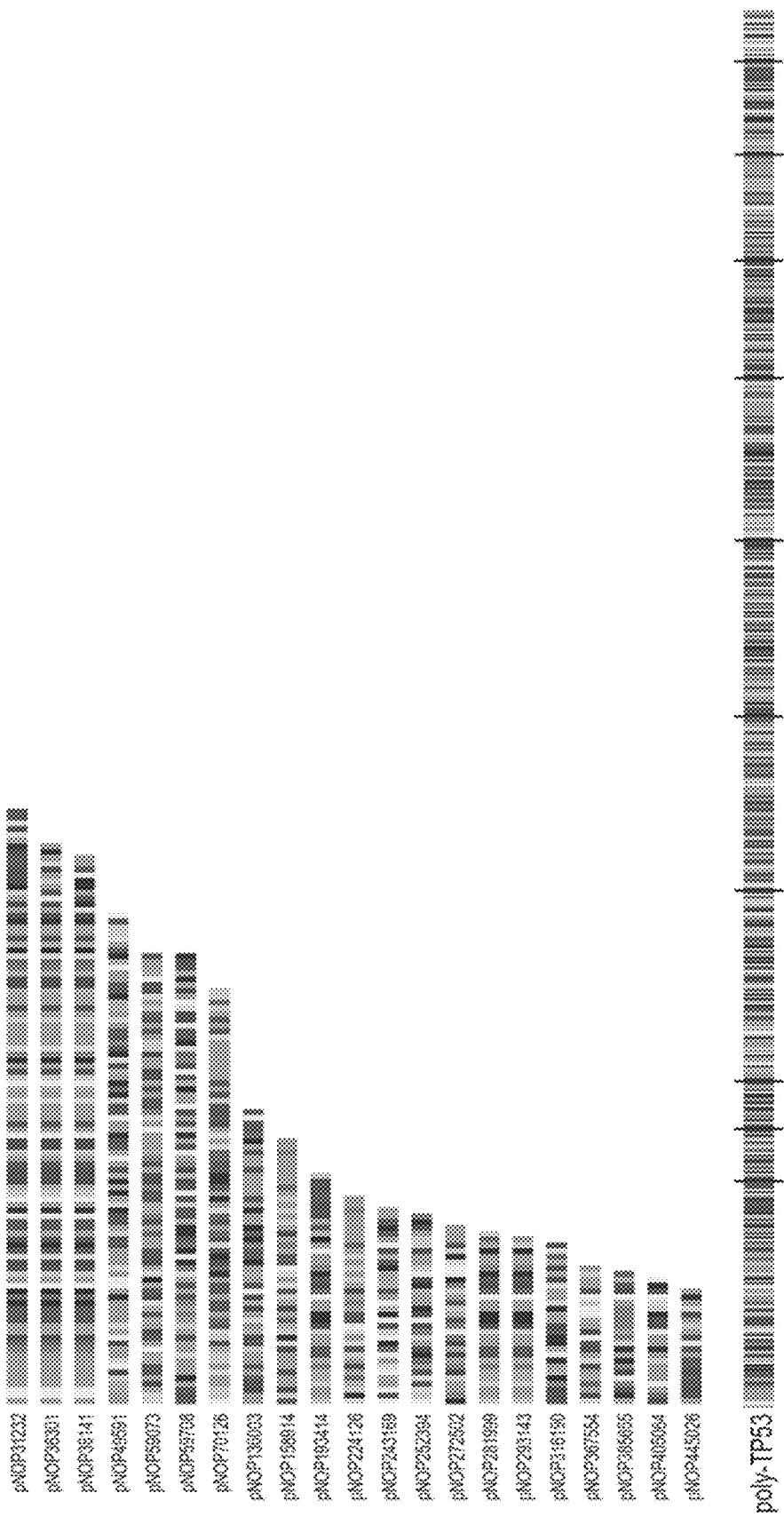
FIG. 5: Example graphical representation of a polyNOP peptide for the gene TP53. On the top all candidate NOPs overlapping with or adjacent to identified frame shift mutations in tumors from the TGCA patient cohort are listed for the gene TP51 and its splice variants. This list of NOPs include NOPs derived from splice variants and which also overlap or are adjacent to a frame shift mutation. Different shades of grey represent different amino acids in the peptides. On the bottom is a graphical representation of a polyNOP combining each of the NOP sequences such that the sequence of each individual NOP is represented in the polyNOP peptide, where sequence redundancy has been removed.

For each of these peptides thus selected we go back to the human genome sequence and define the largest possible open reading frame within the predicted spliced mRNA: it runs from the most upstream stop triplet that is in frame withe the peptide to the c-terminal stop triplet. As shown in FIGS. 4 and 5 result in the case of p53 in 21 open reading frames and corresponding peptides that are encoded by them. The complete list of such peptides (neo open reading frame peptides) and corresponding open reading frames (neo open reading frames) is collected.

All frame shift mutations defined in the TCGA cohort are superimposed on the remaining pNOPs and counted per gene (the collection of all isoforms), where a patient can be mentioned only once for any given gene (if a particular patient has more than 1 frame shift mutation in gene X, it still counts as 1 event). These patient counts per gene were then used to sort in descending order.

See Table 1. The first gene on the sorted list is the p53 gene (TP53), which has 21 neo-open reading frames peptides. These are encountered in 408 tumors/patients in the TCGA database. ARID1A: 229 patients, KMT2D: 160 patients, etc. Now these genes are ordered in a list of descending order of frequency. Starting with p53, the genes are ordered by the number of new patients they add to the group. Note that this is not necessarily the same as ordering by the total numbers of patients in the TCGA that have a neo open reading frame hit, since tumors may contain (and sometimes indeed do contain) hits in more than one gene. The listing in Table 1 orders by the largest number of new patients added. Potentially it is beneficial to have vaccines against more than one neo open reading frame peptide.

For each gene the following routine may be followed; all neo open reading frames as defined above are combined and linked into one polypeptide sequence for every gene separately. Any concatenation can be used for vaccine preparation. In this case we ordered them by the length, starting from the longest peptide, but that is not crucial, since for use as a vaccine for each patient in principle only one domain of the polypeptide is relevant. The peptides can be separated by a amino acid linker sequence. The thus defined polypeptide is then translated back into the encoding nucleotide sequence. In this case we used a table of the most often used and thus presumably most efficient triplet in cases where there is a choice. This defines one open reading frame. In FIGS. 4 and 5 it is illustrated how the p53 gene thus may result in an ORF and encoded protein of 850 triplets and amino acids. This polypeptide now contains all the neo open reading frame peptides encountered in 408 patients in the TCGA database.

Splice variants may be dealt with in the following way: the variant encoding the longest peptide that fulfills the criteria defined above is included in total, for additional splice variants the peptide sequence not encoded by the longest variant is added independently, making sure that we added at least 10 amino acids from the flanking sequence so that each potential epitope may be expected to be in the right context after proteasome trimming.

The list of genes as constructed above is cut off after 1103 genes; the lowest ranking gene on the list still adds 3 new patients based on the TCGA cohort.

Each gene in Table 1 is described by the list of amino acid sequences s that have gone into the fusion product, i.e. the peptide according to the invention. Note that their order within the encoding fusion gene is reasonably expected to be of little systematic effect on the efficacy of a vaccine.

The genes in the list described above can now be used to devise vaccines. Given their length it is assumed that in practice they may also be provided in the form of RNA, DNA or recombinant vectors.

Having now fully described this invention, it will be appreciated by those skilled in the art that the same can be performed within a wide range of equivalent parameters, concentrations, and conditions without departing from the spirit and scope of the invention and without undue experimentation.

All references cited herein, including journal articles or abstracts, published or corresponding patent applications, patents, or any other references, are entirely incorporated by reference herein, including all data, tables, figures, and text presented in the cited references. Additionally, the entire contents of the references cited within the references cited herein are also entirely incorporated by references.

Reference to known method steps, conventional methods steps, known methods or conventional methods is not in any way an admission that any aspect, description or embodiment of the present invention is disclosed, taught or suggested in the relevant art.

The foregoing description of the specific embodiments will so fully reveal the general nature of the invention that others can, by applying knowledge within the skill of the art (including the contents of the references cited herein), readily modify and/or adapt for various applications such specific embodiments, without undue experimentation, without departing from the general concept of the present invention. Therefore, such adaptations and modifications are intended to be within the meaning and range of equivalents of the disclosed embodiments, based on the teaching and guidance presented herein.

It is to be understood that the phraseology or terminology herein is for the purpose of description and not of limitation, such that the terminology or phraseology of the present specification is to be interpreted by the skilled artisan in light of the teachings and guidance presented herein, in combination with the knowledge of one of ordinary skill in the art.

SEQUENCE LISTING (4307 sequences)

SEQ ID NO: 1 - protein, 51 aa, Homo sapiens
SPKRVSLPPAIKNSCSRQKGLTQTDILHFLFPTDSLPPPSLPPLPFWVLGL

SEQ ID NO: 2 - protein, 46 aa, Homo sapiens
LARTPLPSTRCFANWPRPALCSCGLIPHPRPAPASAPWPSTSSHST

SEQ ID NO: 3 - protein, 40 aa, Homo sapiens
ASTAQQHQLLSPAKEETTGWRIFHPSGPDQLSKRKLLKRA

SEQ ID NO: 4 - protein, 36 aa, Homo sapiens
CFANWPRPALCSCGLIPHPRPAPASAPWPSTSSHST

SEQ ID NO: 5 - protein, 34 aa, Homo sapiens
GLGTQGCPGWEGARGEQGSLQPPEVQKGSVYLPP

SEQ ID NO: 6 - protein, 33 aa, Homo sapiens
GACLCLSWERPAHRGRESPQERGASPRAAPREH

SEQ ID NO: 7 - protein, 31 aa, Homo sapiens
FHTPARHPRPRHGHLQAVTAHDGGCEALPPP

SEQ ID NO: 8 - protein, 30 aa, Homo sapiens
ASTAQQHQLLSPAKEETTGWRIFHPSDPWA

SEQ ID NO: 9 - protein, 29 aa, Homo sapiens
ASTAQQHQLLSPAKEETTGWRIFHPSDAT

SEQ ID NO: 10 - protein, 103 aa, Homo sapiens
TGGPSSPSSHWKTPVVIYWDGTALRCVFVPVLGETGAQRKRISARKGSLTTSCPQGALSEHCPTTPAPLPSQRRNHWMENISPFRTRPAFKKKIVKESMKMVL

SEQ ID NO: 11 - protein, 28 aa, Homo sapiens
VRKHFQTYGNYFLKTTFCPPCRPKQWMI

SEQ ID NO: 12 - protein, 97 aa, Homo sapiens
TGGPSSPSSHWKTPVVIYWDGTALRCVFVPVLGETGAQRKRISARKGSLTTSCPQGALSEHCPTTPAPLPSQRRNHWMENISPFRSVGVSASRCSES

SEQ ID NO: 13 - protein, 24 aa, Homo sapiens
MRPWNSRMPRLGRSQGGAGLTPAT

SEQ ID NO: 14 - protein, 95 aa, Homo sapiens
TGGPSSPSSHWKTPVVIYWDGTALRCVFVPVLGETGAQRKRISARKGSLTTSCPQGALSEHCPTTPAPLPSQRRNHWMENISPFRCYLTYDGVTS

SEQ ID NO: 15 - protein, 23 aa, Homo sapiens
QFLHGRHEPEAHPHHHHTGRLQW

SEQ ID NO: 16 - protein, 22 aa, Homo sapiens
RWSGPSSASYPSGRKFACGVFG

SEQ ID NO: 17 - protein, 20 aa, Homo sapiens
TRRKLKILSVGVSASRCSES

SEQ ID NO: 18 - protein, 85 aa, Homo sapiens
SSQNARGCSPRGPCTSSSYTGGPCTSPLLAPVIFCPFPENLPGQLRFPSGLLAFWDSQVCDLHVLPCPQQDVLPTGQDLPCAAVG

SEQ ID NO: 19 - protein, 78 aa, Homo sapiens
CCPRTILNNGSLKTQVQMKLPECQRLLPPWPLHQQLLHRRPLHQPPPGPCHLLSLPRKPTRAATVSVWASCILGQPSL

SEQ ID NO: 20 - protein, 78 aa, Homo sapiens
LRLTFSTSCSPLTASHPHLSLPCHFGFWVFEPLLAIGVRQKHPGLPFALSRGSTEQVGLHWCFVVGRRMGSRTYQLRF

SEQ ID NO: 21 - protein, 72 aa, Homo sapiens
GAAPTMSAAQIAMVWPLLSILSEWKEICVWSIWMTETLFDIVWWCPMSRLRLALTVPPSTTTTCVTVPAWAA

SEQ ID NO: 22 - protein, 58 aa, Homo sapiens
RTNPTVRMRPHCVPFWTGRILLPSAASVCPIPFEACHLCQAMTLRCPNTQGCCSSWAS

SEQ ID NO: 23 - protein, 57 aa, Homo sapiens
ETSGPLSPLCVCEGDWWIDSGQQEQKMAGTCNQPQCGHIKQCCQLLEKAVYPVSLCL

SEQ ID NO: 24 - protein, 56 aa, Homo sapiens
TTRQMGHPRQNPNPRNPVLLLQPMRRSPSCMSWVVSLRGRCGWTVIWPSLRRRPWA

SEQ ID NO: 25 - protein, 54 aa, Homo sapiens
CLAQCQLPQCRHGWRHKPHGCRRSNAWTAWHPTLWHTPSREDESRLHGQPALWP

SEQ ID NO: 26 - protein, 282 aa, Homo sapiens
PHGAARRRRWRQQRWGGGASSLSRGRLAAPSLRLRATLRPEPVCRRRRRGRRLPPTTWRTTKPWPGSAAERRRRGPGALRGAPAELSRPRLPQPPVQLLLPQPQRLPPARPGLRAELPERWHSGLRRGGGCRLQAASLLQRLRLLVVFVLRSAALRGHGGRRPLRGRRGNSPAHRHPHPQPTAHVAQLGPGLPGLPRGRLQWRAPGRGRRQGPGGHGLAVLGGCGGGSCGGGRLGRGPTKEPPRAHEPREQRRRGAAARPDPSAIQSNGSDGQDETSAIWRD

SEQ ID NO: 27 - protein, 140 aa, Homo sapiens
SSSVSFLSSYLPSPAWHPRPFPVPCWLSRQCCSVSLRTTLACCSARQPDATSATQWPVGQHHASFHEPIKHCPRSRLYAEEPPDAPVQFPPARLSLISASAFRRTDTHRHGLLPAELHGELWSPGGSVWPTRWLPQAAKL

SEQ ID NO: 28 - protein, 50 aa, Homo sapiens
SPGPLFHPGPQCRPFPAETGLGNPQQTQHPGQQCGPDSGHTPLQPPGEVV

SEQ ID NO: 29 - protein, 49 aa, Homo sapiens
CGHDAAGCPRAACLGQGGREPLRVYSVRITAVGHLGITVDELIGFTSHL

SEQ ID NO: 30 - protein, 49 aa, Homo sapiens
SHTACVEAEEAAHNERHWNPGGMAGNDVPQVWSPGREHMGIRYHQHPAV

SEQ ID NO: 31 - protein, 46 aa, Homo sapiens
AYPDPLREQDRAAAFPASRTLPTSPSEACDNSRGYTRDNRPGGAPT

SEQ ID NO: 32 - protein, 46 aa, Homo sapiens
QGPLHLTTSPHQACRITFLRYPALLPCPGQWRTAPLLASLHSCTLG

SEQ ID NO: 33 - protein, 130 aa, Homo sapiens
APREVALRAPARRRLPAPSRLPPPAPPPPRRLRPSLSSASGPWGEAAPPRPAGELPSPPPPPPSTNCSRRPARPGATRATPGATTVAGPRTGAPARARRTWPRSVGGLRRRQLRRRPPREGPNKGATTRP

SEQ ID NO: 34 - protein, 44 aa, Homo sapiens
QVSIPALWDENAEGRSPSTCLAHSTCPCAAPHDSAGYHLPTWLC

SEQ ID NO: 35 - protein, 39 aa, Homo sapiens
NAAHRSEGQPRRLVAFPWHTPAPIWSLCPCAPHDKAPSI

SEQ ID NO: 36 - protein, 39 aa, Homo sapiens
QQQRVHQGQQTRRGPHLMDLQKNGSQPLWMTCCLLGLAP

SEQ ID NO: 37 - protein, 35 aa, Homo sapiens
CGGLPARCLPWPRWTRTTQSLLCTNHGCWTSRYHR

SEQ ID NO: 38 - protein, 32 aa, Homo sapiens
PRMELRVQRPSRRAASFHLALAQHRATGTSRS

SEQ ID NO: 39 - protein, 31 aa, Homo sapiens
VTPPWATGLMALTWPICHLRLGQGCVPHQGA

SEQ ID NO: 40 - protein, 106 aa, Homo sapiens
FLWQSVLHPRHPFWQPLPQPADYNVSTATAELQAANGWHIWPSCQAARRGDVQRAIQHWAGAASAAAVAPSPAPACQPATSCPAFPSARCIQPVWQCLSCHCHSCY

SEQ ID NO: 41 - protein, 30 aa, Homo sapiens
RTALPPHSSSRARPASSTCRTHPLSQLVWT

SEQ ID NO: 42 - protein, 222 aa, Homo sapiens
PILAATGTSVRTAARTWVPRAAIRVPDPAAVPDDHAGPGAECHGRPLLYTADSSLWTTRPQRVWSTGPDSILQPAKSSPSAAAATLLPATTVPDPSCPTFVSAAATVSTTTAPVLSASILPAAIPASTSAVPGSIPLPAVDDTAAPPEPAPLLTATGSVSLPAAATSAASTLDALPAGCVSSAPVSAVPANCLFPAALPSTAGAISRFIWVSGILSPLNDLQ

SEQ ID NO: 43 - protein, 27 aa, Homo sapiens
LRSTRTKNGGNLQPTSMWAHQAVLPAP

SEQ ID NO: 44 - protein, 26 aa, Homo sapiens
STLRDPHIPWVEPWPTILQGWQPAQR

SEQ ID NO: 45 - protein, 23 aa, Homo sapiens
LCQQAEHGLCPPGPRLSWREPNR

SEQ ID NO: 46 - protein, 93 aa, Homo sapiens
ALGPHSRISCLPTQTRGCILLAATPRSSSSSSSNDMIPMAISSPPKAPLLAAPSPASRLQCINSNSRYPALLPCPGQWRTAPLLASLHSCTLG

SEQ ID NO: 47 - protein, 92 aa, Homo sapiens
AATKWSGGGTAWRCSGKTPWLHSPTSRGSWTYLHTPRAFACLSWTDSYTGQFALQLKPRTPFPPWAPMPSFPRRDWSWKPSANSASRTTMWT

SEQ ID NO: 48 - protein, 21 aa, Homo sapiens
PIIMPTGRARALPPRAPPIMA

SEQ ID NO: 49 - protein, 90 aa, Homo sapiens
TNQALPKIEVICRGTPRCPSTVPPSPAQPYLRVSLPEDRYTQAWAPTSRTPWGAMVPRGVSMAHKVATPGSQTIMPCPMPTTPVQAWLEA

SEQ ID NO: 50 - protein, 19 aa, Homo sapiens
EMWRWDHDSTIPMEVLMTE

SEQ ID NO: 51 - protein, 18 aa, Homo sapiens
GRARRYEPEPSVKTLQLA

SEQ ID NO: 52 - protein, 185 aa, Homo sapiens
PCRAGRRVPWAASLIHSRFLLMDNKAPAGMVNRARLHITTSKVLTLSSSSHPTPSNHRPRPLMPNLRISSSHSLNHHSSSPLSLHTPSSHPSLHISSPRLHTPPSSRRHSSTPRASPPTHSHRLSLLTSSSNLSSQHPRRSPSRLRILSPSLSSPSKLPIPSSASLHRRSYLKIHLGLRHPQPPQ

SEQ ID NO: 53 - protein, 79 aa, Homo sapiens
AHQGFPAAKESRVIQLSLLSLLIPPLTCLASEALPRPLLALPPVLLSLAQDHSRLLQCQATRCHLGHPVASRTASCILP

SEQ ID NO: 54 - protein, 14 aa, Homo sapiens
PLPPAAAAAAAATT

SEQ ID NO: 55 - protein, 179 aa, Homo sapiens
ALGPHSRISCLPTQTRGCILLAATPRSSSSSSSNDMIPMAISSPPKAPLLAAPSPASRLQCINSNSRITSGQWMAHMALLPSGTKGRCTACHTALGRGSLSSSSCPQPSPSLPASNKLPSLPLSKMYTTSMAMPILPLPQLLLSADQQAAPRTNFHSSLAETVSLHPLAPMPSKTCHHK

SEQ ID NO: 56 - protein, 69 aa, Homo sapiens
YGWHDQPSGTPIFHGWNHGQQFCRDGSQPRDDGPWGCKVNSSHQNEQQGRWDTQDRIQIQEIQFFYYNQ

SEQ ID NO: 57 - protein, 67 aa, Homo sapiens
KSSISSVSMPLNARLNGEKTLPQTSLQLLIPRSPSPRSSLPLLRDQDLCRGPRLPSQPAVPWQKEET

SEQ ID NO: 58 - protein, 66 aa, Homo sapiens
PKEPGVPGDGCGTAGQPGSGGQPGSSCHCSAEGQYRQPPGLPRGQPCRHTVPAEPGQPPPHAEPTL

SEQ ID NO: 59 - protein, 65 aa, Homo sapiens
KGGGTGPRGELQQSGVVVGLLGDAPGKHLGYTRQHLGAVGPISIPREHLPACPGRTPTLGSLPFS

SEQ ID NO: 60 - protein, 64 aa, Homo sapiens
FWPHPPSAAWRSCIALWCASSVTERTRCAGRWLWYCWPTWLRGTAWQLVPLQCRRAVSATSWAS

SEQ ID NO: 61 - protein, 63 aa, Homo sapiens
HGQYATSGWVRDVSPTRGHEPENPRNCCRHACCCQLYPKQAARLPQYESRGHDGNWTSLWTRD

SEQ ID NO: 62 - protein, 58 aa, Homo sapiens
HPGLCLLKLFAHHPLPLASSPLTLILAHPHALSPVTHLPHCISHPDPSPLKLPLRLGL

SEQ ID NO: 63 - protein, 57 aa, Homo sapiens
GEAQGGGGWTPPFSLPIHHCYPQGRARTCCQFPWPGAKARTEHDGQPGYPDGHRAIF

SEQ ID NO: 64 - protein, 57 aa, Homo sapiens
PTLRWGLGGSQQPCPRGQQVSSMPRSQVGSPPILSGPLGRVHLWAPPLPCVSLSLRQ

SEQ ID NO: 65 - protein, 148 aa, Homo sapiens
APCQGPKWAAPQFCPVPWDGCICGHPLSHAFHFPSGSRGAFPKAPCPSAWSPATPWDQQPFWARPHLGQASKHKLHSSHRELPPIGQPPGAQQRVHRGELWAVPTTPSVGSATTCTRRIPPLPVPWSLTAIRHHLSCRKARRPRDWNG

SEQ ID NO: 66 - protein, 55 aa, Homo sapiens
PTGPTSPHSPAARGTGQPAPRCCPHHFHWQPHYPRRLVYLCGRVPEAAGGLGAWP

SEQ ID NO: 67 - protein, 52 aa, Homo sapiens
KHCSCYAQSTVRGLHIWRRLAVQCVRGQGSCVTCSSVPAVGITITGPAWTLL

SEQ ID NO: 68 - protein, 494 aa, Homo sapiens
TRRCHCCPHLRSHPCPHHLRNHPRPHHLRHHACHHHLRNCPHPHFLRHCTCPGRWRNRPSLRRLRSLLCLPHLNHHLFLHWRSRPCLHRKSHPHLLHLRRLYPHHLKHRPCPHHLKNLLCPRHLRNCPLPRHLKHLACLHHLRSHPCPLHLKSHPCLHHRRHLVCSHHLKSLLCPLHLRSLPFPHHLRHHACPHHLRTRLCPHHLKNHLCPPHLRYRAYPPCLWCHACLHRLRNLPCPHRLRSLPRPLHLRLHASPHHLRTPPHPHHLRTHLLPHHRRTRSCPCRWRSHPCCHYLRSRNSAPGPRGRTCHPGLRSRTCPPGLRSHTYLRRLRSHTCPPSLRSHAYALCLRSHTCPPRLRDHICPLSLRNCTCPPRLRSRTCLLCLRSHACPPNLRNHTCPPSLRSHACPPGLRNRICPLSLRSHPCPLGLKSPLRSQANALHLRSCPCSLPLGNHPYLPCLESQPCLSLGNHLCPLCPRSCRCPHLGSHPCRLS

SEQ ID NO: 69 - protein, 49 aa, Homo sapiens
PVRLTDRPYISAFPRSQGHWAARPPLLPPPFSLAAPLPPPACLPLRTGS

SEQ ID NO: 70 - protein, 131 aa, Homo sapiens
KAAVRHCRGPFFKVDSLWAICPPAAQWTPTQASASPRSWILGSAGASLARNPVSPTAPGRAQVAPRPPPPQPPPRRVRATDSPITSGVFSAGRRMRSWASCPPSHLCSMPTLIFLISSKTTQTGQAVANKS

SEQ ID NO: 71 - protein, 44 aa, Homo sapiens
NRLMRRLNGRPCCGGWSQDPWALRSALPLLLMPLNPAWHLCSLR

SEQ ID NO: 72 - protein, 128 aa, Homo sapiens
RSRLVYTASPGRLCVPSSALPKKLAVSSQKLMLRSSSWLQSSRARSRNNWIRSGNSRRSTLISWQNIGTSSSNNSSSSSNNSNSTQLCWLSALPRVPGCSPSSLVSCSLAMGCSHHRGLRVGKPEVFA

SEQ ID NO: 73 - protein, 128 aa, Homo sapiens
WTARSWLVRIKIQNRQLMDLQLLRTQVPLSQTCPTHMWERSLSLVLGVPGFRRLLRTAVGVRCGVVLSVTAGSPVYTGSGSYGALSCHLIGPGVQWCPLGGAQGPMRQCCPVRTYHRLVSLRALHLPT

SEQ ID NO: 74 - protein, 41 aa, Homo sapiens
KTWRPMTPTWMTCSMETSLTCWHILILSWTLGTRRISSMST

SEQ ID NO: 75 - protein, 41 aa, Homo sapiens
LLGPNLRPLRAAVLCPLAHCPPTLSPECLPVLSPSPAPSLH

SEQ ID NO: 76 - protein, 40 aa, Homo sapiens
CRTCVWYVAALAGGQRATSLPVRSALSAITLTVSTARSPR

SEQ ID NO: 77 - protein, 38 aa, Homo sapiens
EPWGRGRQSFRAPALAPTFWGVPEGPRGEEGRAWGILS

SEQ ID NO: 78 - protein, 38 aa, Homo sapiens
LPHILPGPPTAHRPQGRLEVQVVCVLYAVWGCFPWLPL

SEQ ID NO: 79 - protein, 119 aa, Homo sapiens
SRRRARCLALTRLVSSSSSSHPRCPPKCLRRTPLDWPLPIPWSPASPRHRPPIPPILVLRGPLRSPRCWAPHLVLGLASQGNSTLPHLAPPDTSPPHLTHSSNPAAPRWITWLCLRALG

SEQ ID NO: 80 - protein, 117 aa, Homo sapiens
ARVMPVPVFLAQSPSWALQTRRGVAPCPWSWGSLRMLVQPEMRAPYGSVLTHCQRLMTHYCAMLGQLSAEAKLRGRRGGGAAPQPVPASNRVAAAVSQEDAGLVEEPMEDVVEDGPG

SEQ ID NO: 81 - protein, 117 aa, Homo sapiens
PCHHCTSGANGEDGLASQARQDWRVLSPQMPLALMTRRMGTWTPMSCSRVKVVWSTWSAKLNWRAPSALMWSLAKRRPRKAKNASVNHIGLALVVSWCDSGNPTHARKRGLLHRRRC

SEQ ID NO: 82 - protein, 114 aa, Homo sapiens
NRRAPPQSHPLSTAIPTMSPIWMCDSSRPHLLKNPPRPLPPWHLLLPVPLLSPWLNFPPNPWLSHPSPHLCHWPHPLNQPDPSPVPGPLKKVKIPVLLASRNGKECAGSGFGCC

SEQ ID NO: 83 - protein, 33 aa, Homo sapiens
RRKSLGHPLLAMGPQTWALLTHPPQAPTWVAWS

SEQ ID NO: 84 - protein, 32 aa, Homo sapiens
VRTPTDWLLKGFGAWRYQVFPHRNPQPHRPLN

SEQ ID NO: 85 - protein, 107 aa, Homo sapiens
PQGTSTHRAAPWGPAAGPQGRAMGCPHYALRRFCHHLHPTDPSPTCPMEPHSDQASPLLSKSEKTQGLEWVALWRQLNSQVPRTQACPALAKQSWRSNGSASDYESC

SEQ ID NO: 86 - protein, 30 aa, Homo sapiens
HHSAGRTAAHVPCGGPCVPRHRTAAASPDG

SEQ ID NO: 87 - protein, 105 aa, Homo sapiens
GQGLDLRAHPGSLPHQEPYLQDQSLALSIPHLHHPALKSQRDLHNYLPPAPSFPLRPSSLPPIQGPPNLRGQPWSRLLGGSHLLLPSLQIPCLARVWDLGIPQTT

SEQ ID NO: 88 - protein, 27 aa, Homo sapiens
CHQIPFLLHSHPSSQLRPHRPCLLWGS

SEQ ID NO: 89 - protein, 24 aa, Homo sapiens
GWVSSPHFAGGWGVPSSPARGASR

SEQ ID NO: 90 - protein, 23 aa, Homo sapiens
VEARPPLLGHRTRAALWGCPQAS

SEQ ID NO: 91 - protein, 88 aa, Homo sapiens
CCSRAGVVWSVLCVRCVARPPTPHACCSVMTVILATTHTAWTPHCSPSPRAAGSASGVCPVCSVGLLPLASTVNGRIVTHTVGPVPAW

SEQ ID NO: 92 - protein, 17 aa, Homo sapiens
GAATLPPVRGAAPVTPA

SEQ ID NO: 93 - protein, 79 aa, Homo sapiens
SKSLASFSGENGCTCSVWGALCSTPSDSCCLTRWLTFIVPLPSIPWATRPRASIGASAPTIVAAAIAVLLVRTTGGRSL

SEQ ID NO: 94 - protein, 77 aa, Homo sapiens
GHQEPATTSCWQALAQKLGICSCRSYSGQRMCNSALGGGPRGCELRSTGTLTASWLGWSRNYRVPPATRRMQQQGSL

SEQ ID NO: 95 - protein, 76 aa, Homo sapiens
GIPTQHQAGTSGRAMCPGSPVSEEGGQWGANRGTRNQQPPPAGRPSLRSWASALAEATPGKECATQHWAGVRGAAS

SEQ ID NO: 96 - protein, 72 aa, Homo sapiens
ACPPYDPSPISRLPSGAGFSHPDGAPSSSVFATPSAFPGSPKLPSFPVLSSCPTTVRSLPVESHREGSGGLR

SEQ ID NO: 97 - protein, 72 aa, Homo sapiens
HHAEYRGSLLQHRQICPNAGHVCGMWQLWPGGRGPPPCLFAVLSVLSPLLCQQQDHQGDAAQGLALCGVYCV

SEQ ID NO: 98 - protein, 165 aa, Homo sapiens
YRATTSQTRTCPPVWAGSAWGWNHAYGGSASSTAPRSPGQKPTAAALKSSAAAAATGTPHAAAAAAESGSTPDPTLPGAWDPDLSPPGPPGLPTSTWGLPWTTDRPPPGARGRASTSGPTPAPCPTRSLIYRTSPWPCPSHTSTIQPSRAKETFTITFPQLPASH

SEQ ID NO: 99 - protein, 65 aa, Homo sapiens
AWGTTSVPSARGAAVVPIWGAILVASADATRSPSSSTLTHHHSCGPTGPVSFGGVRVPLWCQRGQ

SEQ ID NO: 100 - protein, 62 aa, Homo sapiens
VLSSSSSYRHSSCSGSCSRVRQYARPHPTRSLGPRPLPSRASWAANLNLGASLDHRQAPSRS

SEQ ID NO: 101 - protein, 60 aa, Homo sapiens
TDRTGPSLSPSEGCLQPGEQGRPVRTVRPPQPHSGGGMPMGTLSAMPVGSTTSFTILTDP

SEQ ID NO: 102 - protein, 59 aa, Homo sapiens
PPWVEPPRRPTTPSPPTRPTCPSTAPDSSPPAACWAAPPPASDASPGPRPGPAQKAGSV

SEQ ID NO: 103 - protein, 58 aa, Homo sapiens
PPWVEPPRRPTTPSPPTRPTCPSTAPDSSPPAACWAAPPPASDASPGPRPGPAQAGSV

SEQ ID NO: 104 - protein, 57 aa, Homo sapiens
PRPRRCTRHPACPLDHTTPPAWSPPWVRALLDAHRAPSESPCSPFRLAFLQEQYHEA

SEQ ID NO: 105 - protein, 48 aa, Homo sapiens
AQAKAVCSQESRDVLCELSDHHNHTLEEECQWGPCLQCLWALLQASQY

SEQ ID NO: 106 - protein, 46 aa, Homo sapiens
RRKASRPETEKCLANPKSAKKCMTHWRTSPRTARLTRPPSPDTCPP

SEQ ID NO: 107 - protein, 113 aa, Homo sapiens
PGRPLQTHVLPEPHLALQPLQPHADHAHADAPAIQPVLWTTPPLQHGHRHGLEPCSMLTGPPARVPAVPFDLHFCRSSIMKPKRDGYMFLKAESKIMFATLQRSSLWCLCSNH

SEQ ID NO: 108 - protein, 18 aa, Homo sapiens
QTPDYEEGRHPDQKPKNV

SEQ ID NO: 109 - protein, 182 aa, Homo sapiens
ATTTPPCSTGSTRTRTTRASATPTWTRRSTRCRRRWMCFLTSTVKATTSRPTTETRSGPRCRGTLRPTTGARCAARLCFMDPYPGWTAAKPWAATTPPPPGISAPSPRRPSTTAPRGPSPSTPRPRPPPCRGATPARTSSPSRPPRRRTSPRTHRCPPQARPARPGRTRKSASSTRCPCPTA

SEQ ID NO: 110 - protein, 60 aa, Homo sapiens
KFGERTRNWSRQLPSSNRKSRNFFKARFADLHHCSPDCQSHGRSVSHSYLSGRQKFWVYH

SEQ ID NO: 111 - protein, 59 aa, Homo sapiens
VPARIWKNEHRGHLRTSMKPAHMMLSGRMKVKEWEKSTWQLLVMVRVQLHEWTMKQPVF

SEQ ID NO: 112 - protein, 58 aa, Homo sapiens
SKANQSCDGRTTRYLPGYGKTSTAKNSQNSANRKGHTSYTTAFTVPSNRSREVISEQA

SEQ ID NO: 113 - protein, 53 aa, Homo sapiens
APVIFQIALDKPCHQAEVKHLHHLLKQLKPSEKYLKIKHLLLKRERVDLSKLQ

SEQ ID NO: 114 - protein, 47 aa, Homo sapiens
FIFQEFEIAPQVQVLFLKKAHPLRLQPPKALVKVKQPPLLLEEPSHL

SEQ ID NO: 115 - protein, 47 aa, Homo sapiens
QVIWEPRYALTVKPVGSGRKLMNQAWTRTKIQCQLLLNIRSVLLCVF

SEQ ID NO: 116 - protein, 39 aa, Homo sapiens
CLQFRKMTMGMKQNQSSLKNQMKTKRKRQKKLLILKRTY

SEQ ID NO: 117 - protein, 39 aa, Homo sapiens
VPRHLIVVSRDTSKVSMVIMFLTPIDMMIIGQTILILAT

SEQ ID NO: 118 - protein, 38 aa, Homo sapiens
QMREMHLEEALLPIHIQTLTISLSRKIQIGHVLCLMPN

SEQ ID NO: 119 - protein, 117 aa, Homo sapiens
LCLAPKTAVYPCDSLDVFLSSSSFYMAMTKTLYCWEIPGAVKRLGPGPVQHSTTSFTHSLMTREAGVKSESFIFWNRYALTVKPVGSGRKLMNQAWTRTKIQCQLLLNIRSVLLCVF

SEQ ID NO: 120 - protein, 33 aa, Homo sapiens
MLQFRGSRFFQMLILYYILPRKVLQMDFLVHPA

SEQ ID NO: 121 - protein, 26 aa, Homo sapiens
YFITFCHGKYSRWIFLFIQPECSEPR

SEQ ID NO: 122 - protein, 93 aa, Homo sapiens
AKFQQCHSTLEPNPADCRVLVYLQNQPGTKLLNFLQERNLPPKVVLRHPKVHLNTMFRRPHSCLADVLLSVHLIVLRVVRLPAPFRVNHAVEW

SEQ ID NO: 123 - protein, 18 aa, Homo sapiens
IVLVLKKIEVWRENAELV

SEQ ID NO: 124 - protein, 82 aa, Homo sapiens
NMPQIFLHHRNSHFHSQRVHLDKAVKPNICLQAVRIRPHLHLMPRGRISSIQVLHRVEVVSLKRLPLAKFLLLTKKQYRLIV

SEQ ID NO: 125 - protein, 73 aa, Homo sapiens
KNVLFLPCQQSHHVKQKSQPRLLQNYLHLWQGNQVSCLCTNFYHHKTGCNPKSMLVLHRGMICHGCIVLKGHL

SEQ ID NO: 126 - protein, 73 aa, Homo sapiens
PEFSKSKRTYFVYDSFYSPKQQKQRGHLRTSMKPAHMMLSGRMKVKEWEKSTWQLLVMVRVQLHEWTMKQPVF

SEQ ID NO: 127 - protein, 73 aa, Homo sapiens
VLSVTLTKKTTIKKMNLSKRLSPLTHRENQVNLKHQAMLLNHFMLKIPQFVSQETVLSVLLVLTLKMTCCRNV

SEQ ID NO: 128 - protein, 64 aa, Homo sapiens
NKVSKDNQGIKVQLILFILRALMINTSSSNHILDSRNVFLHTGHGEPMVQKQIEWVLIMELIKM

SEQ ID NO: 129 - protein, 53 aa, Homo sapiens
SWKGTNWCNDMCIFITSGQIFKGTRGPRFLWGSKDQRQKGSNYSQSEALCVLL

SEQ ID NO: 130 - protein, 49 aa, Homo sapiens
HQMLVTMNLIIIDILTPLTLIQRMNLLMKISIHKLQKSEFFFIKRDKTP

SEQ ID NO: 131 - protein, 44 aa, Homo sapiens
YQSRVLPQTEQDAKKGQNVSLLGKYILHTRTRGNLRKSRKWKSM

SEQ ID NO: 132 - protein, 43 aa, Homo sapiens
GFWIQSIKTITRYTIFVLKDIMTPPNLIAELHNILLKTITHHS

SEQ ID NO: 133 - protein, 40 aa, Homo sapiens
NYSNVQWRNLQSSVCGLPAKGEDIFLQFRTHTTGRQVHVL

SEQ ID NO: 134 - protein, 32 aa, Homo sapiens
QKQKEISRGWIRLRLDLYLSKHYCYGISCRKT

SEQ ID NO: 135 - protein, 32 aa, Homo sapiens
RYIPPIQDPHDGKTSSCTLSSLSRYLCVVISK

SEQ ID NO: 136 - protein, 27 aa, Homo sapiens
PIFIQTLLLWDFLQKDLKAYTGTILMM

SEQ ID NO: 137 - protein, 22 aa, Homo sapiens
QKMILTKQIKTKPTDTFLQILR

SEQ ID NO: 138 - protein, 21 aa, Homo sapiens
CLKLFQCSVAELAILSLWSAS

SEQ ID NO: 139 - protein, 21 aa, Homo sapiens
QPSSKRSLAETKGDIKRMDST

SEQ ID NO: 140 - protein, 15 aa, Homo sapiens
KMEVYVIKKSIAFAV

SEQ ID NO: 141 - protein, 15 aa, Homo sapiens
LFPVRGAMCIIIATC

SEQ ID NO: 142 - protein, 15 aa, Homo sapiens
RIIWIIDQWHCCFTR

SEQ ID NO: 143 - protein, 13 aa, Homo sapiens
NLSNPFVKILTNG

SEQ ID NO: 144 - protein, 55 aa, Homo sapiens
FILKRNPTNVKNVAKPLTGPQPLLAIREYILVRNPTNVKNVAKPLTGLQLLLNIR

SEQ ID NO: 145 - protein, 116 aa, Homo sapiens
LNIRKFILERIPTDVKNLAMPLISPQPLLTIREFMLVRNTTDVKNVAKHLTTTQPLLTIREFILERNPTNVKNVAKPLAGTQPLLPIREFILERSPTNVMNVAKPLAYPQPLLNIR

SEQ ID NO: 146 - protein, 36 aa, Homo sapiens
KSFMHFQMQIDTRQDILERNLSSVKNVANHFACFHN

SEQ ID NO: 147 - protein, 11 aa, Homo sapiens
ENSYWRETLQM

SEQ ID NO: 148 - protein, 321 aa, Homo sapiens
FILERSPTNVKNVAKLLTSLQDLLDIKKFILERNPTNLKNVAEFLPVPQHLLKTRKFILERNPTIVKNVAKFLPIPLHLLDIREFILKRNPINVTNVAKLLTGPHTLLAIGEFILERNPTNVKNVAKPLSSPQTLTVIKKFIVERNPTNVKNVAKLLSCPQDLLNIRKFILERNLTNVKNVAKLLTGPQDLLNIRKFILERNPTNVNNVTKLLPTPQTLVVIRKFIVERNPTNVKNVAKLLIGPQDLLNIRKFILERNLTNVKNVPKLLPGLQDLLNIRKFIGWVWWLMPVIPALWEAEVGGSRGQEIETVLANMVKPRLY

SEQ ID NO: 149 - protein, 154 aa, Homo sapiens
RRRRGGVGRRGVRPGRVRPGGTGRRGGDGGRAAAARAALGELARALPGHLLQSQSARRAARMAQLRRRAAALPNAAAWHGPPHPQLPSPHDSSGPVLRSPCPRGEHIPPGETDRCKDRNKPGSCWRRKSRPCVAWEIDLPACWEMEGLRLCGFS

SEQ ID NO: 150 - protein, 50 aa, Homo sapiens
TRASPPRSSSAIAVRASCCPYGSTSTASRSPTQRCRLARAAASTATECIL

SEQ ID NO: 151 - protein, 49 aa, Homo sapiens
TRASPPRSSSAIAVRASCCPYGSTSTASRSPTQRCRLARAAASTATESS

SEQ ID NO: 152 - protein, 31 aa, Homo sapiens
SSLRITGDWTSSGRSTKIWKTTQMCRKTWSG

SEQ ID NO: 153 - protein, 105 aa, Homo sapiens
RRRRGGVGRRGVRPGRVRPGGTGRRGGDGGRAAAARAALGELARALPGHLLQSQSARRAARMAQLRRRAAALPNAAAWHGPPHPQLPSVYSERAMPPGCPEPSQA

SEQ ID NO: 154 - protein, 29 aa, Homo sapiens
RTAYFCQYHTASVYSERAMPPGCPEPSQA

SEQ ID NO: 155 - protein, 104 aa, Homo sapiens
RRRRGGVGRRGVRPGRVRPGGTGRRGGDGGRAAAARAALGELARALPGHLLQSQSARRAARMAQLRRRAAALPNAAAWHGPPHPQLPRSPLALQRCRDTRWASG

SEQ ID NO: 156 - protein, 91 aa, Homo sapiens
TRASPPRSSSAIAVRASCCPYGSTSTASRSPTQRCRLARAAASTATEVTFGSSEMQGHTMGFWLTKLNYLCHLSMLTDSLFLPISHCQCIL

SEQ ID NO: 157 - protein, 81 aa, Homo sapiens
ELQETGHRQVALRRSGRPPKCAERPGAADTGAHCTSTDGRLKISVETYTVSSQLLMVLMSLDLDTGLVPSLVSKCLILRVK

SEQ ID NO: 158 - protein, 57 aa, Homo sapiens
RRWCLALHRTLAQSLLPSMELQDPLQPLVREVPWRPLGGPRCCPPELLVLSVRPVRT

SEQ ID NO: 159 - protein, 56 aa, Homo sapiens
QGAILLPAAHPGPAPGPGHAALSGPWLLPVSPGHSRLPGPLCRHLSLQGLSAVEDP

SEQ ID NO: 160 - protein, 120 aa, Homo sapiens
RQPSPAFPWGPLRQVPLGGLALHPGSLWSLAQSESQLPQSLSLRGSPHHQPLHPCQRPGLPRPGAAPHCPHLLRSGPAPRALRPWPANSPAHLQTGASLGRAWRIVGSLPLLPARPQLQL

SEQ ID NO: 161 - protein, 38 aa, Homo sapiens
EDAPAAARSPTPPRVPSARGTSSPLTVQVQKPRTCLGS

SEQ ID NO: 162 - protein, 109 aa, Homo sapiens
RSVRCARRSCRLPLPRSSPLELRLLSLYRPPLAPLLPLPPLPAPQGALTPPHPARTLARPRLPRHCLHPQSRGLDSLAGRGLPSPPPHPQVPPQLPQAGEGPLRRCQDL

SEQ ID NO: 163 - protein, 219 aa, Homo sapiens
HVSAGWRGRPATATGEPALLSTCAEWCPAPQQDHPADPGACEHTQRPGAAPEPSHTPWTHLSASEGPVALLHQNHLCAVSGRARAAPGYQPCVQPGWNSHLVRAHELCSSRLHLAGAQRPRLRAAPALSRPSPTAGSRSGGRVTCAQSPAAACLCSPRRSCHNSILLWQPCTHLLSTPGPAIPGPPKPGLHCGHQHNPTCSHHSAQGPASPCHCHPSPD

SEQ ID NO: 164 - protein, 25 aa, Homo sapiens
GRCLGGHWAAPAAAHPSFSFSACGQ

SEQ ID NO: 165 - protein, 23 aa, Homo sapiens
SVPPLPTAAPHWTLSPQGPRILL

SEQ ID NO: 166 - protein, 204 aa, Homo sapiens
PLAKAMVPPHPPLRPRLLPPQPRQPPPSHWAQEPSRPRSLVRAAQRAPYGPHPLGLGVQRHLPRQPGSSQWILPPSGARDPKVWVAWSHQAPQSSRPLPAEEETSCRHWCCPQTRRSKRAAEPECPPPPPHHWPMGPQQLPCPVLPPPWSPMWCGLSAALLCPSPLSPSPPLAGLRRLQMTQQVPGLKWALGLGCLGAPRWVSA

SEQ ID NO: 167 - protein, 91 aa, Homo sapiens
APVRCSPDTPELRHQGSGEQLLWGRTATHSWGTWLSPAPSFLPQRGTQPGRRRSRQSGATGTDADGVWPCIVLWPKAFYPVWSSRTLCSPW

SEQ ID NO: 168 - protein, 195 aa, Homo sapiens
CIRTRSRQQPPHQPHTWWLDPCWALWGRRLPLSLTYWWAPRGMGPLRPLLSSSLPRGPLVVGPLRAQEQVLGVAPMGQYPWASCNQVPWARLGESPRYSTSCPRCPSSFRWHLPQHQPLGPRQRLPAALHPPPASVSPSHRALPPTAKSWLPLHPLLASPSCSLYPPPHPPKPSQFLPCRPRPRVAQPSCCLGRS

SEQ ID NO: 169 - protein, 17 aa, Homo sapiens
LCGQQGPVRSGLRRALC

SEQ ID NO: 170 - protein, 79 aa, Homo sapiens
DHGQQIPQLIFRLARPWAGPGESWGASHSSQPGPSSSCSPWWQQREQQWAGSRGHPGAQGGGWYWQEGEGAAPAPEEDL

SEQ ID NO: 171 - protein, 75 aa, Homo sapiens
RRPLTLWTTGSCQKWTSKSALLSCLSFGLRRCCPPPPCSLWPPHPGPSWALTARRGRTPRTWIQHPRTPPRPSAR

SEQ ID NO: 172 - protein, 175 aa, Homo sapiens
APRAPGSSCSLWQRLWFRPILLCVLACFLLSLGSHLLLTGLRNLQGPGVWSGQHSGPPTAPTPWGWGSSDTFQGNPVPPNGSCHLPAQETRKCGWPGATRPLSHRGPSQRRRKHPADTGAAPKQGGARGRRSQSALRPRPITGLWGPSSSPVPSCRHHGHQCGAACQQHSCAHRL

SEQ ID NO: 173 - protein, 167 aa, Homo sapiens
PTGGHPGVWGPCAPCCPVHCPGGPWWWDHCGLRSRCWEWPQWASTPGHPATRCPGQGWGNHPGTVHPAHAAPAASGGTCPSTSPWDQGSGSQRPCTHHQHPFHPPTGHFHQRQSPGCHCTHSWHPHPAVCTLRPTPQSPVSFSRAGPAPGWLSPAAAWEGPSASGRP

SEQ ID NO: 174 - protein, 67 aa, Homo sapiens
QHFTLAALHPPPQHPWPSHPRPPQAWSTLWPPAQPHLQPPFCPRARQPLPLPPQPRLALSPAPQQVP

SEQ ID NO: 175 - protein, 163 aa, Homo sapiens
SPSWHPASLTPPCSRARPSNLPATQWPPTRAKNLLSRQLLLMNGHQVGQGVLTLSGPLEPHALRAQDPDPHTLWGWWNLVRVRLPPRRRRPPAPQESPGWTVRQRVTMMMPSSPSCLLRSSCLYRPENVGPSPSVPYPRNGTHLLRRMDAAPTSGRRTTSGGP

SEQ ID NO: 176 - protein, 43 aa, Homo sapiens
IVSTCIRMFQQRNKEQIKVPVVNIRNLIEKKNLNMNLPTLLKI

SEQ ID NO: 177 - protein, 38 aa, Homo sapiens
SRQQIIQKSVLLQNYVSLRLLSLCWLILRRLILHWKKT

SEQ ID NO: 178 - protein, 114 aa, Homo sapiens
AVKIQKILIFRNQELVKKLVNPKMNSGPEQGLQRKQSWKKISGAINRKRKGDVLRFKKIHPVKTRVILRKKRRKKKRRRKRRRRRKRRRKMKMMIPSLLEKAERKFGRFLKMIN

SEQ ID NO: 179 - protein, 35 aa, Homo sapiens
RPHKKDHLMMLKENKRERLSLQQKAQLIKTRPSWN

SEQ ID NO: 180 - protein, 34 aa, Homo sapiens
YYYAELAKRRWASWDCELHCLWTTGQSFSKRFHL

SEQ ID NO: 181 - protein, 33 aa, Homo sapiens
MLSLKQKHEKEKNLVLWKRRIFQSQKLNFQENR

SEQ ID NO: 182 - protein, 33 aa, Homo sapiens
PCVSTYQLGPIYPLSVSTLKLLIFLSIWEPCQQ

SEQ ID NO: 183 - protein, 32 aa, Homo sapiens
KSQKTRRRWASWDCELHCLWTTGQSFSKRFHL

SEQ ID NO: 184 - protein, 32 aa, Homo sapiens
RKTRAMKLLKMIKSRAKRELKKKRNLQTLRKK

SEQ ID NO: 185 - protein, 31 aa, Homo sapiens
APMIIQKRRKKGKRGKKIVAQVEVAVTMMLK

SEQ ID NO: 186 - protein, 29 aa, Homo sapiens
IYKSNSKWSVCRFYHGRCQSDEKTCSHSL

SEQ ID NO: 187 - protein, 29 aa, Homo sapiens
LKWNNSMNLHLMALKSYLSEKKFVIFLRA

SEQ ID NO: 188 - protein, 26 aa, Homo sapiens
VTENLEKKKRQSLKSIKKSKAETEER

SEQ ID NO: 189 - protein, 22 aa, Homo sapiens
VCEKNKEISRFRMHSCPLYGPW

SEQ ID NO: 190 - protein, 18 aa, Homo sapiens
FLKRNDKPSLSLLIMTQN

SEQ ID NO: 191 - protein, 67 aa, Homo sapiens
EIKLLKRRMNYLIMLRSQQGKEIVVTLQRIKRVRMEHMVERRKGASCLERVQGRDKIVHHLILRNIP

SEQ ID NO: 192 - protein, 67 aa, Homo sapiens
KKLKPIFPLMRMDLQMMSQKKGKKELENKMKKTQEMRKQKIKSILNQIQILKNLRSQDTDIGFCGTN

SEQ ID NO: 193 - protein, 64 aa, Homo sapiens
EIDFLRSSKQVLPLMVSISFLGKRRVLLLWKLEKLLKLKKRASISKPKHVKKYRMAYLILQRNS

SEQ ID NO: 194 - protein, 46 aa, Homo sapiens
MPRKVPQTSPIERTREALRNLGKLRSSVTEGPTGPQLPPPQPTPLS

SEQ ID NO: 195 - protein, 28 aa, Homo sapiens
LAGHGRGPGSGRGGAGAAGGGGAAQRTE

SEQ ID NO: 196 - protein, 102 aa, Homo sapiens
RRCGRCWRRGRCPTHRIVTVGGRSRWVEGLQREQGMAGDSGGRSLQGNWNQVALRFSGKRGGFLGSFQKGFVITDLLLATPWGLGKPRKRNEEPRAYRSLEC

SEQ ID NO: 197 - protein, 26 aa, Homo sapiens
RRCGRCWRRGRCPTHRIVTVGGRSRS

SEQ ID NO: 198 - protein, 91 aa, Homo sapiens
WAAPEWRSCCCSTARSPTAPTPPLSPDPCTTLPGRASWTRWWCCTGPGRGWTCAMPGAVCPWTWLRSWAIAMSHGTCARLRGAPEAVTMPA

SEQ ID NO: 199 - protein, 75 aa, Homo sapiens
LRSEADPGHDDGQRPSGGAAAAPRRGAQLRRPRHSHPTRARRCPGGLPGHAGGAAPGRGAAGRARCLGPSARGPG

SEQ ID NO: 200 - protein, 60 aa, Homo sapiens
LLTSSFFLTMQSPIISQILLNIKPLANSGICTFEQEMSLFRKEKQMTKMMMKMGKTIRAQ

SEQ ID NO: 201 - protein, 58 aa, Homo sapiens
RLATVSSSSPMAWCVLVWAELKKYGFEMELHIFMAPSSFTQKKQSMSPQKCSTKKKYF

SEQ ID NO: 202 - protein, 51 aa, Homo sapiens
WVAIRQAFHLCRAQLMALLAWAACSHFTLGGLHPTIFRQVCLASRASHHRV

SEQ ID NO: 203 - protein, 50 aa, Homo sapiens
QVLHTVKAALVKREIPLASITVIKEQYKEVVYQQLQWHFNMAQKVKKMLL

SEQ ID NO: 204 - protein, 49 aa, Homo sapiens
ILLPCAMNSIIPSETIRMNRADFSVSSSLGHQSEEINQTIMKWFLSPLT

SEQ ID NO: 205 - protein, 48 aa, Homo sapiens
CSGMPGTIMRRAPRFIMMHISWRSYSRRKGKSWAHCLMMMTWLLPNSS

SEQ ID NO: 206 - protein, 47 aa, Homo sapiens
GLQHQVEVHMDNRWEFWGLQGSRHHLHIPAHIQLDPLSYSSQQHPCL

SEQ ID NO: 207 - protein, 47 aa, Homo sapiens
NFSSFLLKFVMNSAKMERFFFHRHSAIPQNICIMMWRKRERKNCQKK

SEQ ID NO: 208 - protein, 44 aa, Homo sapiens
KSYSMLFLKLESQVQAEDFVTYLWLNHPKRTILIIIKSSWSQWT

SEQ ID NO: 209 - protein, 125 aa, Homo sapiens
ASVWSCLSRNTLSYAQKTSEMRMFLSVNHGILPKPNLLRKLNCGPCPSAQSGLSLGMCLCLWFAWPLYLQMQIKVMMRRIQTTQRTVELKTILTWKRKKKMSLWKCPMVNQVATTLSSSITMTCG

SEQ ID NO: 210 - protein, 41 aa, Homo sapiens
HVFSESVLCCHSRTSSPAGQLKYQKMTFCFVRAATMRATSR

SEQ ID NO: 211 - protein, 36 aa, Homo sapiens
KVEMMILKRWEKKIVSLPQSLPKAVQRRKAPNGKST

SEQ ID NO: 212 - protein, 108 aa, Homo sapiens
HGQHAATSPWGASTPPSSARCAWPPGHPTTGCDEPRSGPYGRDSSTRWKSIWTTGGSFGASRAAGTTSISRPTSSWTPCHTAANNTHVCSSPTKDPAASSLRGLPEIH

SEQ ID NO: 213 - protein, 29 aa, Homo sapiens
ISSQKMPKLIMSLALKYSRMQIQLKKYFI

SEQ ID NO: 214 - protein, 29 aa, Homo sapiens
STKMLLFYTKSCLKHAETWREMRTLMSQM

SEQ ID NO: 215 - protein, 24 aa, Homo sapiens
NCSKLCRQRRKSLPGETISRTETA

SEQ ID NO: 216 - protein, 93 aa, Homo sapiens
NEKKKKEKLKRVKIPLVLQASQAYIAHTARTVALKTACTMLEITSMWNLQRPTYNHISSVLKDCGRIQLVKNGCMAVGFTDQMKHSTWLHENF

SEQ ID NO: 217 - protein, 92 aa, Homo sapiens
NEKKKKELKRVKIPLVLQASQAYIAHTARTVALKTACTMLEITSMWNLQRPTYNHISSVLKDCGRIQLVKNGCMAVGFTDQMKHSTWLHENF

SEQ ID NO: 218 - protein, 20 aa, Homo sapiens
KAHGHGKNSKSHDGQQVPRY

SEQ ID NO: 219 - protein, 87 aa, Homo sapiens
NEKKKKEKLKRVKIPLVLQASQAYIAHTARTVALKTACTMLEITSMWNLQRPTYNHISSVLKDCGRIQLKKKFLRVTITTKFQLVKF

SEQ ID NO: 220 - protein, 78 aa, Homo sapiens
RCDEPRSGPYGRDSSTRWKSIWTTGGSFGASRAAGTTSISRPTSSWTPCHTAANNTHVCSSPTKDPAASSLRGLPEIH

SEQ ID NO: 221 - protein, 13 aa, Homo sapiens
KIKIHDSNAAETK

SEQ ID NO: 222 - protein, 12 aa, Homo sapiens
KMVVWLLVLPTK

SEQ ID NO: 223 - protein, 63 aa, Homo sapiens
KVEMMILKRWEKKIVRSLNLLLYLSFRPPWPVSWTSCPTHPHSLPQSLPKAVQRRKAPNGKST

SEQ ID NO: 224 - protein, 59 aa, Homo sapiens
MKRCWSNSCCQKSAIFFTPVVKETSMQLNFGILPLGFYFLSAATTSMQSLVAFLPGYRN

SEQ ID NO: 225 - protein, 56 aa, Homo sapiens
DVIFLLVEIPVKCPWIMKNYYVLLEPLSGREKGTPLWIVQQDAAEPPRFADKPRPN

SEQ ID NO: 226 - protein, 54 aa, Homo sapiens
WTLPIPGLAIALKQTFSLSGLLFFLALLTTTSPQSISITVTPGSGSTPSIMSGC

SEQ ID NO: 227 - protein, 47 aa, Homo sapiens
ERDFCFDILGNSHRSFVGDHGGMHERYSNVQVAGPVDRTSSKICIPI

SEQ ID NO: 228 - protein, 46 aa, Homo sapiens
SKKTGARNPRQYSRINYRARPTGPSVTHARDCSGSNGGSAGSSSVR

SEQ ID NO: 229 - protein, 41 aa, Homo sapiens
LKSSSMPSSVPPQNSPLNFEVCATVYTRWLASVSLRTASVQ

SEQ ID NO: 230 - protein, 34 aa, Homo sapiens
KVLPCHHQFLLRIPPSTSKCVPLFIPGNLPLPTE

SEQ ID NO: 231 - protein, 32 aa, Homo sapiens
NIESHFFLLIFQWKMFLWIHIPFIMVTLPIGH

SEQ ID NO: 232 - protein, 29 aa, Homo sapiens
CSRMQRNPPDLPTSPDQTRSGPVHVSVEP

SEQ ID NO: 233 - protein, 29 aa, Homo sapiens
KKFISLSVDYIGYTGKMSCWATKGHNEIR

SEQ ID NO: 234 - protein, 28 aa, Homo sapiens
KVLPCHHQFLLRIPPSTSKCVPLFIPGG

SEQ ID NO: 235 - protein, 25 aa, Homo sapiens
LEFWLLCLILGIYSTNCSGTCFLKK

SEQ ID NO: 236 - protein, 24 aa, Homo sapiens
QALNLKKNLQTWRQEAISIFSCPW

SEQ ID NO: 237 - protein, 23 aa, Homo sapiens
CGSSSSLPLPRCYFLSSHRSALP

SEQ ID NO: 238 - protein, 22 aa, Homo sapiens
KKKRKTKNQWLASVSLRTASVQ

SEQ ID NO: 239 - protein, 18 aa, Homo sapiens
GLASAQSPLLGSCGCAAA

SEQ ID NO: 240 - protein, 16 aa, Homo sapiens
NFWKSVFLDLANLVLN

SEQ ID NO: 241 - protein, 16 aa, Homo sapiens
NGNSEDFLITTAPTFT

SEQ ID NO: 242 - protein, 14 aa, Homo sapiens
AADRKCCNCLCQTV

SEQ ID NO: 243 - protein, 12 aa, Homo sapiens
LCHFPTCSVHGG

SEQ ID NO: 244 - protein, 73 aa, Homo sapiens
VTAMCLLYIVYSGTIRRKLGSIFPATGIIKLLEDDLLIRWQHFLHTWVLQSTNLWQIHTGPALTLPVQSLRNL

SEQ ID NO: 245 - protein, 59 aa, Homo sapiens
NDVNIESWNPLHGSQIHLYLILLNNQRTEKDQLITLNLLVLLIFLSRIITLQQICIFLL

SEQ ID NO: 246 - protein, 52 aa, Homo sapiens
SHCSRYVSFSCKISKEKRFNYACKFYCKCRDTSNLSLPDPEAIEIYLSFTVL

SEQ ID NO: 247 - protein, 44 aa, Homo sapiens
CYVSLTILLNSHLPCCSKNHIKQLLYPLMVHLEHPGEVRTGVHG

SEQ ID NO: 248 - protein, 44 aa, Homo sapiens
KQIFCSMLPPGPLPCHQYLTFLEALTSFLVHPYGFLEGTSIFHP

SEQ ID NO: 249 - protein, 33 aa, Homo sapiens
DTSLKRNLLKLWDRVVSKLDHSDTNLEFACITE

SEQ ID NO: 250 - protein, 33 aa, Homo sapiens
LGRKFHLWMEYWEVIFKRKRNCGESVSLLQQLT

SEQ ID NO: 251 - protein, 29 aa, Homo sapiens
IQNHCNSIQGSSSCCSGDIQTCFDQRRGV

SEQ ID NO: 252 - protein, 24 aa, Homo sapiens
HLMDFQRLKIFLNDTKKFILKIKI

SEQ ID NO: 253 - protein, 19 aa, Homo sapiens
FTLTDSWREHLYFTPEESI

SEQ ID NO: 254 - protein, 14 aa, Homo sapiens
KSVSASLSPAKYTL

SEQ ID NO: 255 - protein, 273 aa, Homo sapiens
LAIRSTRPSCAAPFIPSASAPMGRAATSSTTRTSGGPRRRGAPPGTCVPLARAMRCTWASRGSRGPSCTTASASRASRRATISPRAASSRRCCSTAPRRARRRRPPALRPRPAPPPPPPVPRPPRPPRPRAPRHAAPPRRPRLRPLCCTAPGAPRTCWRRGPRARPARRPRAPTTPSPSVRSSAASSRRSPSRPTTLPPWPPPPTTAVSSSSSSRAWRPPRSRRRRPARPSPPGPPHLPRRPSASSCRAACPTRPCSTRPPAPRTRCRTATAT

SEQ ID NO: 256 - protein, 22 aa, Homo sapiens
GAVGGRRHSPAQQGEQIPGPLV

SEQ ID NO: 257 - protein, 347 aa, Homo sapiens
RERRSQPAPPAPAAAAEGGRRLPDQLHALQDRAVPALRGERHVQVRRKVPVRAWLPRAAQPDSPSEVQDRAVPHLSYHRLLPLWAALPLHPQRGRAAARAVGGRLRGPACLWHARCVAPGLPAGAAAQVAPQPQLLGLPVGPPSAPGRPRVAAAARQPHVAHAAAALLLFGLVLLLLRLLLFLGLRGLHALGRPDMLRLRGGRGCGRSAVRHRGRRGPAGAGGPVRGLLVGLVRQQRLRLRSGAQQPHHAARHPDPQLCRRGRRRLLPQSAAAAAAGPGAPRAAAGAAQRDPPRRGRRTSLAALQLPAAAPPVRLARVRRAPQPPGLAVGPRQLPKRLPELRQPQRL

SEQ ID NO: 258 - protein, 158 aa, Homo sapiens
TTCWTRRRWGRLWPPPPARASRRDSSDGTRPATCMHSPTPRPAPAAARPSSRAPLTAAAAAARRPAVRPPTAPLRSRRGAAAQPCSTRRTNSGTARLARTAIAASTSCTCSSSRRGAAAPRSTPRATRPSCAGPSRRAARASTAKSASSRMASTSCAA

SEQ ID NO: 259 - protein, 58 aa, Homo sapiens
APRGEHRVGRAPLRARQQGGHLQRMFGLLCQPPDLHGAPLPQRAPPATPERGERQRHR

SEQ ID NO: 260 - protein, 148 aa, Homo sapiens
VNISSRPCTNTEQSREQQETPKSTLVYYLTLPASPILAPHLPRSLPLTQTTAPLPRRPPPPPPLPPTPPGSLGRKWSPGLRQRSPLLFLLSPHLQRLPQVHAAPQGFSPRCQQTTIRRSLTRISAKSPTDRRARWRVPKTPAAPRTVV

SEQ ID NO: 261 - protein, 52 aa, Homo sapiens
PRVTLPSFSQASTPKRRTNWSSKKRKKKARERGTAPRGERATPVRRKHCQMP

SEQ ID NO: 262 - protein, 132 aa, Homo sapiens
RRSTRSRGAPVSTAKAGSPTPGWHEARATRVVTSLSAARCVTTPQLPKATSVFICSLTSISTTCRTCRMEGGSRSSATLPGRRRRRWLRRRRQPISVAPAGPPRRPNQKPNPPGGARCVIMRPTWPGTSAFT

SEQ ID NO: 263 - protein, 131 aa, Homo sapiens
WGCPQAPYCSSTSNTSRVCRRQFSSSSSGNYSSSSSKKCSSSSPKQAKPQSPPGLLPQTKTLPKNPPNQKNRKTPPVRCPPSCRNSLKSQKQKAKVRTPSTTPSLFQRCSTSWSAASARRASATRRQRGAT

SEQ ID NO: 264 - protein, 42 aa, Homo sapiens
RRRKRHTKGKGNPCLSPRRRKERPPRQLQPRSQPRCPPWSMR

SEQ ID NO: 265 - protein, 39 aa, Homo sapiens
QASQQHAEPAEWRGGAGLQPHCRGGGGGGGCGGGGSQYQ

SEQ ID NO: 266 - protein, 37 aa, Homo sapiens
HWTAKESRSGLVPECPGKRKEVQVKHGQAFWYKPNEL

SEQ ID NO: 267 - protein, 34 aa, Homo sapiens
ALAGASAAPLPERAEPVHPPPVFGQVPGYAFHAL

SEQ ID NO: 268 - protein, 104 aa, Homo sapiens
ETKAGGSSQCTAKPNPRKARTTKARAAAARAARAEDQHSPAEAPPAGVPAFVATASSTSAPSTVPLTPVEPQSFPALPPAPQAPPHINSSTARKPTSSANPLPV

SEQ ID NO: 269 - protein, 191 aa, Homo sapiens
ESKGEGKGTQRERGTPACPQEGERRGPHGNCSHDLSPAAHHGVCGRPCTAAGPAGRVDFGPHSIAHKPVPSLLCTRLFSLLCSPDPWRPAERVPAAYVWHGRPVPLQPCTVAGPDGAVPRLPTAAVPAIPAESAGGNSAAAAAATTAAAAAKSAAAAAQSKPNPSPPRGSFPRQRPCQRIPQTRRTEKHPP

SEQ ID NO: 270 - protein, 82 aa, Homo sapiens
RPKRRKSWHQGVVLSLPCSLHALLQMPEGTPPRPCWRTLALSWSSSIMRTSRRCRKRMGRLTRERTWKSSSVTPAASCFPTS

SEQ ID NO: 271 - protein, 67 aa, Homo sapiens
GPRPQSHHHLPLHPLHPHFRQRRLSRRPHQPSPHQPHPSPHLQLHRPSHQCRSPSSPCRWSCPSSRR

SEQ ID NO: 272 - protein, 65 aa, Homo sapiens
SSTGSGTLSSKRGSVTRTPLTTSVILLSPAWRSSRLTPGPLRRNLQSRSTGEARGLQEQGLRTTS

SEQ ID NO: 273 - protein, 61 aa, Homo sapiens
APQPQHKPRWRWALSNPPSSSSSSSNHRCSSLPRRQQPSRHPHHSSHCNSSSNARTKTVRK

SEQ ID NO: 274 - protein, 54 aa, Homo sapiens
WALGAAASRRCCCCCRSPLGSARSRSPATLALTPRATRSRCPGATWREAASWAE

SEQ ID NO: 275 - protein, 45 aa, Homo sapiens
CRPSSQYISLHSRTNTRGECQLDHSVQRPNPRIYHFEAKDGLRGG

SEQ ID NO: 276 - protein, 45 aa, Homo sapiens
FCCSCCFFGGERWSKSPYCPQRMTPGTTFITMMKKEAEKRTRTLT

SEQ ID NO: 277 - protein, 45 aa, Homo sapiens
KESGSVRGLWRGPGNHILHCPGARHIYGTENNISDLERHCQLAGD

SEQ ID NO: 278 - protein, 26 aa, Homo sapiens
ILKIAPVDKGQPIFPSTPDSKWAQMV

SEQ ID NO: 279 - protein, 97 aa, Homo sapiens
IQWGTTTAPRPIRPPFLESKQNCSHFPTPLLASEDRRETGLFLPSAAQKMKKAHFLKTWFRSNPTKTKKARFSTASLAKELTHPLLVSLLLKEKQDG

SEQ ID NO: 280 - protein, 20 aa, Homo sapiens
RRCTNPHECPPVSSPPCQSR

SEQ ID NO: 281 - protein, 16 aa, Homo sapiens
LQTMVLQLLLEQGHFC

SEQ ID NO: 282 - protein, 73 aa, Homo sapiens
PTDPFLGLRLGLHLQKVFHQSHAEYSGAPPPPPAPSGLRFWNPSRIAHISQLLSWPQKTEERLGYSSHQLPRK

SEQ ID NO: 283 - protein, 61 aa, Homo sapiens
TPTMPPSLTPSSAKILSSLTKICSPLTGTQESSVWSPLGWTERVSLRIPWWFKLLTFKVRG

SEQ ID NO: 284 - protein, 54 aa, Homo sapiens
AAPAAATVAQTPRPWTTQDACPSSADFPSQMTKPGSAGRKAEKADEDFDLSGTL

SEQ ID NO: 285 - protein, 49 aa, Homo sapiens
ASPRSELARQPLPRPLLLGRGRAAAAHPEAARGRPGQLQPLQDGAVPPL

SEQ ID NO: 286 - protein, 49 aa, Homo sapiens
VRGQVPVRTRHPRAPQPDPPPQVQDGAVPHLPHHRLLPLRAPLPLHPQR

SEQ ID NO: 287 - protein, 47 aa, Homo sapiens
LSPQPSGFSLGPGGLPEQLQQQPQWLRLPDLGQLKTPAHLQQTFHLR

SEQ ID NO: 288 - protein, 46 aa, Homo sapiens
CSQCRGLPAGQKGSGHPCWWGLPSEALSHPAQLQVPPEPAPQQPQG

SEQ ID NO: 289 - protein, 35 aa, Homo sapiens
AAPAAATVAQTPRPWTTQDACPSSADFPSQMTKPG

SEQ ID NO: 290 - protein, 32 aa, Homo sapiens
LCWVSQCRCHRRCHRAAGQPHVHHPTPYSERR

SEQ ID NO: 291 - protein, 24 aa, Homo sapiens
HGAARGWLPDHLPLPAHVRVPSHV

SEQ ID NO: 292 - protein, 84 aa, Homo sapiens
PATPSTRRSCAAPSTPSAFAPTGPAATSSTTLKSAVPWPGPGTSPLTVPASSIALALLGFPVPLPPPLPPGCWTAPRPSPHPLF

SEQ ID NO: 293 - protein, 73 aa, Homo sapiens
APMTSWAHLPCPMAPITLLPSPARSWQASLPLAWGCPGVAPRPPSSSGPCPSPLTCLTLPPALRILSRTRRAT

SEQ ID NO: 294 - protein, 67 aa, Homo sapiens
ARETAASETAPSRKGASGCCPPRSSPGAARSTPAATRRSCAAPLRKTVPVSTGTSASSHTASTSSAA

SEQ ID NO: 295 - protein, 65 aa, Homo sapiens
AKFYARVTRCSTIVLPVQGVACWTERQWAPLLVGASLGGTQSPCPAPSSTRTSSSAASRVSQPPL

SEQ ID NO: 296 - protein, 153 aa, Homo sapiens
YQSKCLRYPGNLFQKRRNLFLFPRRRKLHRQKCLRFLRSQRRKFLCLFLKRRSLRQQKFLKCPRNLCQRRKYQYQFLKRWKLHLPKCQRYPRSLCLRRRCQFLLLRKWRLHLQKCQRCPRSSSQKKRNQHLFRKKWKHHHPKCQRNVNQFQFL

SEQ ID NO: 297 - protein, 149 aa, Homo sapiens
KYQLCIQRRWLFQKKRCSLLLTQRRRCQSQSPRYKRKLLLKRKFTLPFPKGLNHHLKSLSYLRNQLQKKWPLFLSLKKWSPQHQKFLRFPRNPCQRRKSQFLCLRRNLLLPQKSQRCQRNLSLKKRFPFLLQRKRKLPQLKFLKYRREL

SEQ ID NO: 298 - protein, 56 aa, Homo sapiens
VFQLHPQVEALHTLSFLAYVTLHHKLMSRWRKQEKTSGIQPITSQRRLKLVQVMQN

SEQ ID NO: 299 - protein, 55 aa, Homo sapiens
KFLRLKKWKYLKNQKLHLKGLRYLRKSSLQKNRPLKLFLEKSHQLKYRRCLRKLW

SEQ ID NO: 300 - protein, 49 aa, Homo sapiens
LKSVNRVQQLGSLSIPVSSALKLKSLISQNTWNILSVSVQRTDLVSANL

SEQ ID NO: 301 - protein, 48 aa, Homo sapiens
TDANSFLEKRWHTAKTSRRHKDGHAAESVHLGAIQREPEGLRRLYHYC

SEQ ID NO: 302 - protein, 47 aa, Homo sapiens
MLLLEKVLILSVMLLVLNRCESLGQKITRRSVLEETIQSHVWETLLI

SEQ ID NO: 303 - protein, 41 aa, Homo sapiens
ESGGSTCKSARGAQEAHPRRKETNTCSEKSGSTTTQSAKET

SEQ ID NO: 304 - protein, 123 aa, Homo sapiens
KTETVFYGKKPTNWSSAQLTSKSQQSVLDLFMNSGCMQKMLLELENLAILLNQSWQLMLVNPQEMFVSLIFQRTLSAFHGNNQLSMEVARLQATLLRDVTFQMADGPRPASPMLLKLNSSSLA

SEQ ID NO: 305 - protein, 788 aa, Homo sapiens
FLKRKRQWLLLKSLKSHLLKCLRLPKKLFLKRKCQCLLLKSLKCHPQKSQRCQRQLSQKRSCLKLFLPNRKVLPLKCLKCCHRRKWSQKRKYRCLLPKSQKLHLLKFLKLLKKLYLKRKHLWLCPKNRKPHVQKCLKLLKKLSQKRKFPRHQSKNQKPPQLQCQKFLKKPQKKKFPWLHPKNQKLQLSQCLKLKKLSQKRKFLRLLPQNQKPHLPQCLKSHKKLCQKRKHWCFLKSQKFHLLQCQRLPKKLSLKRKCPRLLLKSLKSHLLKCLRLPKKLFLKRKCQCLLLKSLKCHPQKSQRCQRQLSQKRRCLKLFLPNRKVLPLKCLKCCHRRKWSQKRKYRCLLPKSQKLHLLKFLKLLKKLYLKRKHLWLCPKNRKPHVQKCLKLLKKLSQKRKFPRHQSKNQKPPQLQCQKFLKKPQKKKFPWLHPKNQKLRLSQCLKLKKLSQKRKFLRLLPQNQKPHLPQCLKSHKKLCQKRKHWCFLKSQKFHLLQCQRLPKKLSLKRKCPRLLLKSLKSHLLKCLRLPKKLFLKRKCQCLLLKSLKCHPQKSQRCQRQLSQKRRCLKLFLPNRKVLPLKCLKCCHRRKWSQKRKYRCLLPKSQKLHLLKFLKLLKKLYLKRKYLWLCPKNRKPHVQKCLKLLKKLSQKRKFPRHQSKNQKPPQLQCQKFLKKPQKKKFPWLHPKNQKLQLSQCLKLKKLSQKRKFLRLLPQNQKPHLPQCLKSHKKLCQKRKHWCFLKSQKFHLLQCQRLPKKLSLKRKCPWLLLKSLKSHLLKCQRLPKKLFLKRKCQ

SEQ ID NO: 306 - protein, 114 aa, Homo sapiens
QKDMNMSSGLWLKMLLELVHQVLPVHFTRLVTLCLNLDHQVTHVFWIQADHPFQSLGINLSMMVVQKSLGIWLRLPCQRKMNGRLSLHQQDSRQLRILSLASQRIRNIRSASMP

SEQ ID NO: 307 - protein, 112 aa, Homo sapiens
RLFLKRKCPWLLLKSLKSLLLKYQRLPKRLFLKRKCPRLLLKSLKSHLLKCQRLRKKLFLKRKCQRLLLKSLKSHLLKCLRLPKKLFLKRKCQCLLLKSLKCHPQKSQRCQR

SEQ ID NO: 308 - protein, 31 aa, Homo sapiens
SLSHRNYKMLLLRKKTLWQPLNVKLQNHLSK

SEQ ID NO: 309 - protein, 30 aa, Homo sapiens
MKTEKSQLRGAKMGKNSPQGKIIRSVLKIK

SEQ ID NO: 310 - protein, 30 aa, Homo sapiens
SKKQTGVILALMTWFWKINVARRLSTSRSG

SEQ ID NO: 311 - protein, 27 aa, Homo sapiens
KTVLAKVTALYPSMFLIGLCLLPSSAS

SEQ ID NO: 312 - protein, 99 aa, Homo sapiens
VLRMPRRSMEENTLLFLIMQCVELQSPLQSSPLAHHQSPKDPFDLMKSRLIVSSCHGMYLKIMEEEKLLVTASRSGKLHKLTGRWCVQVLPERLSKFLI

SEQ ID NO: 313 - protein, 25 aa, Homo sapiens
HGKKETKFLNRHRELILKPQRLQPF

SEQ ID NO: 314 - protein, 23 aa, Homo sapiens
FPQLKPKNKKLEFLKKLLRNRNK

SEQ ID NO: 315 - protein, 21 aa, Homo sapiens
GCWQLQLSTPKLSNRWQSQST

SEQ ID NO: 316 - protein, 21 aa, Homo sapiens
PSTRASLQGFLVTPMVSRYQL

SEQ ID NO: 317 - protein, 90 aa, Homo sapiens
NQFAVLKGFLPSLSTQWLESLPLLLHGSKKTSSFAPVFITLSFITLMALELSLSMTLRGKTVASISVKQRICWVSPPVQQSCLCFWKTQT

SEQ ID NO: 318 - protein, 20 aa, Homo sapiens
TSPKSPDTSCACTLLLRQSL

SEQ ID NO: 319 - protein, 18 aa, Homo sapiens
RTTHFPQKASSYRDTERS

SEQ ID NO: 320 - protein, 85 aa, Homo sapiens
KKVIPMSTVSVLSTLLDKANHHFAPNQLLARMSWHPQRFTSTSEISSRFELVKLLPSLAVTQANQSLRFPGSKMKLMCWKMIALI

SEQ ID NO: 321 - protein, 15 aa, Homo sapiens
CPQTKSLSLKESPWQ

SEQ ID NO: 322 - protein, 77 aa, Homo sapiens
KPLKMLKSVLNVNFREHHRLRWYGTKTSGNSEAARNTRLHPKTSTQVFTFSMWTLQTSVNTTAKHRMKWEVILVFVL

SEQ ID NO: 323 - protein, 76 aa, Homo sapiens
CMSIVYMLKILLELVNAVNLVNQSLQEILVTLLDNLKSQISQENQCHLNGLNHIMMVELRSQDTLLNAENYQMAGG

SEQ ID NO: 324 - protein, 10 aa, Homo sapiens
CWEKQLHSCG

SEQ ID NO: 325 - protein, 72 aa, Homo sapiens
DTPLPRSDTCGHRPHLRSGPCLQQQESPHPPSGLLGLHCSCVRLRHPPWPQVLKCLPLGSKRATWPPHLRLR

SEQ ID NO: 326 - protein, 164 aa, Homo sapiens
KKKYVFLKSPEFHQLKCLKCCHRRKWSQKRKYRCLLPKSQKLHLLKCLRLPKKLFLKRKCQCLLLKSLKCHPQKSQRCQRQLSQKRRCLKLFLPNRKVLPLKCQRLRKKLFLKRKCQRLLLKSLKSHLLKCLRLPKKLFLKRKCQCLLLKSLKCHPQKSQRCQR

SEQ ID NO: 327 - protein, 66 aa, Homo sapiens
VLVWRLQKSSKESRAKQWAKDLMHTSGSESWGNQTPNVNGTKMVSKLNGLTGSTGTGPKTMFVNWS

SEQ ID NO: 328 - protein, 54 aa, Homo sapiens
FPLNGWQTFQKDLLEFCKNGYYSTPCVFKTVRNAECFQFHSLHQDASPFDGYCR

SEQ ID NO: 329 - protein, 40 aa, Homo sapiens
QHWSETKNCRFWSCSQVGIKRNWCRRVSGTITGDNCIYGT

SEQ ID NO: 330 - protein, 36 aa, Homo sapiens
ELQILELQPGWHQKELVQESFRDNYWGQLHLWHLRY

SEQ ID NO: 331 - protein, 36 aa, Homo sapiens
IDCCWNFLLNFILILSVLMFHKLSLLKSGIRSCCPS

SEQ ID NO: 332 - protein, 30 aa, Homo sapiens
LLTTLNSYSVAFRISMKTKSFTEMSKVPIC

SEQ ID NO: 333 - protein, 29 aa, Homo sapiens
MAERSTDRPWSIFFLLSGSRCGNWNFNGC

SEQ ID NO: 334 - protein, 102 aa, Homo sapiens
CFQPCQPLLLLPHLYQLALQQMSLSIDFRDSFPAEYLLHLLKHSASFLYNSTETVLKTKTQINFPQSLLSQDPCPPVTYTGQSHLDLPQVIQVNREIPQKIA

SEQ ID NO: 335 - protein, 26 aa, Homo sapiens
KWRRYHHYSTGYTRDSTRTYQSKTTV

SEQ ID NO: 336 - protein, 24 aa, Homo sapiens
ARRSSRSTKRRDKNDEPSESSKHH

SEQ ID NO: 337 - protein, 75 aa, Homo sapiens
ERWPSGVFPMMSVGPCCWQMGRALEILGAAVEAARVGEPPVGLPRPVSQEMWWRHAAAFCQWSVLTLSTKCTLLL

SEQ ID NO: 338 - protein, 69 aa, Homo sapiens
YVPFVDLSGDLMISTATSCQVLWIPLLPSELHSSKPYSSSLWLDHEGIKRAILTLLIMELSKSLLLTKI

SEQ ID NO: 339 - protein, 68 aa, Homo sapiens
VSRRGPGKCGFTSFQRPTQSFSWQLPIRSHSEIRISRSKEKKSFPSAFSEWQNHTTPKSPFTRWLLTI

SEQ ID NO: 340 - protein, 62 aa, Homo sapiens
FNNNNNNNNRATKANGSNKRQTPQSVFELLSFISSFPINVSSLVNPFFFYPICTSWHCNRCL

SEQ ID NO: 341 - protein, 302 aa, Homo sapiens
ARAGTAHPARTPTAATAATARPATVGATARPTSTTAGPTRVTTGAPAQTASTRPSATACPASGALSVRRTSTSVPVTPAATGPTARTAWTATRAPAPQASAGSTVRTTRLTAQRAPASTVAPAWTASTRSPACVHPASRAATASTMSMSATHSPACMAAPVRTAAAPTGAPAPRATLAPTARTLCTGVTPRPARTAANAGRPTPSTAASAPAAGPAFTATCPACPVRWLRSDKVLTLPACASMEGSVWTRATRTTAAARRATQAATVRTWWTSAHPAPARTGPPARTTWAATPASAWPATTG

SEQ ID NO: 342 - protein, 148 aa, Homo sapiens
RPRCSLVAARVGGGGGSWTPWTSAAPSSTWRLTTGSVCRPPRSASRVPPTWPHSWERSPRWAASTSPTRSRPCRVRPWSRPRRRSCTSCTWRRPPLCFCSSWAAGCCCPASAGGSMASSGSLRASKCLRPARRSGGSPSARTPWASSP

SEQ ID NO: 343 - protein, 51 aa, Homo sapiens
CRQAPAGGQRRCQHPGQHGPHPAACGCVCRRTRCLPDPDPEPSHRPGCPHA

SEQ ID NO: 344 - protein, 140 aa, Homo sapiens
RGPQDPTARSTWMTVPAAPATRAPVWTRSMATSVPVSRATQGACVTSTSMSVRATPATTGAPARTASMASPAAAPRATTTPPACLRSMSATATPASTGPAGTASTGTSATVTLGGVGPTVTSTTMSVNPTLVSTAAPAKT

SEQ ID NO: 345 - protein, 49 aa, Homo sapiens
IQPLCQRRHLQRHDQWLRVHLPGGLQRSQLPDQHQRVCVQPMSEPGHVY

SEQ ID NO: 346 - protein, 134 aa, Homo sapiens
SRRRASCPSARRTRATRSAACSATTTRAAGTAVTAPSTSMTPGRTARSLCSAGSTSVTATVTASATQPAASSTALTASVRKASATPCTTSTARTTSATGTATRAATARSASGTGWTVRSMYPRGWRPARWWWWC

SEQ ID NO: 347 - protein, 265 aa, Homo sapiens
TALRRSTSASPTPARTGAPASTSPTPTSAPAHGALRVCTVRSTWTTAIPPLTPCPGAPSALTTAPAWTRWAATAAPARRASWVSAVRGMSTSACPIPATPVAPRTACSASMTSTASAVLVTPGAAASPSSMAAKASPARMGAPAPWPPTPPAGSSASALRASRAPRVRMTLVPAAACAASTAAHASPARAAPPACAWAPSRAPNASSRPAAPAWAATPATTRGPVSPHPRAPSTVACAPPNSTGSCATSWTTASGVGPGATSPRR

SEQ ID NO: 348 - protein, 41 aa, Homo sapiens
VESRARQTCSHWAPAAWRCTLFCPRRAPPCPRRCHPRWSHP

SEQ ID NO: 349 - protein, 34 aa, Homo sapiens
VCGQPLPQRGHLRGRHQWLHLPLPRGLPRPHLPV

SEQ ID NO: 350 - protein, 105 aa, Homo sapiens
RPPRSTATPRLWTTPPATSYRCLSTPSSPRPLSPLTSGPARPRIPTSPTGPRASPALPPACSPRSPAFRRPSSKRRAPRDPGFLSQAFGRLCALCGCQGRPEEPF

SEQ ID NO: 351 - protein, 103 aa, Homo sapiens
SGQWHGGLRLWRGLRGPAMPGPQPVPQHPLQERRDMPRGGPQRRGRLCLQLCPGLLWAPLPDTPGQCLPHQPLPQRGHLRPAHADGVQVPLPARLVREIVPAG

SEQ ID NO: 352 - protein, 213 aa, Homo sapiens
QRYAEQQGGDTPVSGRPGGQLRDRQGAAGPLCQPGHHGSYGPPAARHRTGAHASRHREAAGRVQPGAQPAAARSPAGGHAHPVAPALLAQRLPGQPQARRAGQEGPQAQQQRPGLWKQGGQGPQGTEEEVPGRQGLPAGQLRHALARGLPGVTPWLPVRRGLAATAALPVPAVSVRAPQPPAWDARHPPGHRAPERGGQARDGGAGWGRPAGL

SEQ ID NO: 353 - protein, 73 aa, Homo sapiens
TRARVLTTLPGTSATACCPTQVPRVRWCWPRVPPAPAETAGSAGNPRTMRASPVSAPRAGKGRPVRSTSTSAF

SEQ ID NO: 354 - protein, 328 aa, Homo sapiens
CQMPARTAGPATTPTVATTACVSTAGLVRTAARTLMTVPAPPASTAPPAMTVWPPSTASVPMAAQVCCATSTTHASATPVTRAPTATPTLSMARPSAPAPRGTRARPAARTWMSARWVPTPASMRASASTRWAPSSASVCRATRAPDARSTSTSASRTRARTTPPAWTRLGSSSASACPATRVCTARSTQTSVPAAPACTMAAAWTRSMSSSASAPRASLGICASTMWTSVPAPPARMVPSAWTDPTLTPVCARKGTRGRTARWTSMSATPTPATTAPARTASPPSPASAAQATRATTARPTSTSAPASPAATGAPARTATTPTSASA

SEQ ID NO: 355 - protein, 140 aa, Homo sapiens
AVLLMGNCQCCSPTPSTSWLRSSKSPRRTSQFLCPSRLAAGLGVRLWQCPHTRSPHPPPAMRVQTRPLRSAVLSTRHCARLSAQPTRRGPPALSPPTSPRCFLERMTACCVLTAYATTVLSVIWVLSSAQACCTWLRMGC

SEQ ID NO: 356 - protein, 49 aa, Homo sapiens
PWALGGGRGVDRQGPAGHHGAYRPRHCRGALPRHPLQPDGSGARPQDQV

SEQ ID NO: 357 - protein, 43 aa, Homo sapiens
WSRTSPCGGAKGSASAGSTSSGSLTGGNALAPTRPSASEDCWP

SEQ ID NO: 358 - protein, 42 aa, Homo sapiens
VHLHLYLHAGSGRHAGQPSGAEHLRAAAPRGQHRPAPQAAEA

SEQ ID NO: 359 - protein, 40 aa, Homo sapiens
GQAACAEGEPSDSTRGSAAADKSNTARADSDPQVSRVTAA

SEQ ID NO: 360 - protein, 24 aa, Homo sapiens
SLQAAASMGFTPTPLPLSSGCRPF

SEQ ID NO: 361 - protein, 70 aa, Homo sapiens
RTSPRVSALRAKDMRLAMPRSWPRPIIAMPGPSHATSLRSRMALVQCGPWRRSTLSAMCLSQAGSLSWMG

SEQ ID NO: 362 - protein, 67 aa, Homo sapiens
TITIMPSPPCRRKKTWRQVWAAAEFQSAHPSSTQMMRMTMRMTRRMTCRTPTLPLGIRGREQGSQGH

SEQ ID NO: 363 - protein, 64 aa, Homo sapiens
GLAGAGERPRPLHPARGRFRCQGGASGGDLRPSEQMSGPCIWIYLPVQMDRRAPVPAKGLYLGG

SEQ ID NO: 364 - protein, 63 aa, Homo sapiens
FRPTSLKSHSCLRSPSQPATSPRWCWKQTGPLQPLRATTQMVQRRRLVHAHKPHPTALPTNPS

SEQ ID NO: 365 - protein, 56 aa, Homo sapiens
TTPLPLTLSLRVRCRIQGRSNHPHRGPTISPTNTWDPLPLLLCTQQRPFHLDVPAA

SEQ ID NO: 366 - protein, 51 aa, Homo sapiens
PQVCRSKWKREKLHSDHHCLHKPTASRHLPQSHQNHSGWAPRTSKTSAETR

SEQ ID NO: 367 - protein, 32 aa, Homo sapiens
TGAAAAHSHEGQPTPPSPHAQPSCLPEPLHCL

SEQ ID NO: 368 - protein, 107 aa, Homo sapiens
RRPRCQHEPPLHAAFHRAEPRQDERGVAAGRPGRRRCPGRQAEERRPQHGGGAGRPPGRAGAHRQPQLPLLRAAYALALQQDPAHRFQGGGPRGCSRWHSGHCDGWQ

SEQ ID NO: 369 - protein, 25 aa, Homo sapiens
MIRPSPGACPFPSGSVNWSSCGAQP

SEQ ID NO: 370 - protein, 338 aa, Homo sapiens
PSASESDAGYKADPTIPTVVLRSVLPIPGIHCLSFCAPSNAHFTWTCQRHDNPLCRTFQSTLNGTRPDSVQRPAPVPRAALHLRPPHALSRRLHLLPDAGHLGHRHRHVGHGLGHALPHLPAAALPRLVASAGRPVPSQLALLPPVLRRLGRLLPVLHGGRRALAAAHPAALHQRLHRLRAAQPQPPEPERRGGGRGQPQQLPHQHGALRAPGGGRVEALLRRQAWPGWAPRAAAFASGRAGLLFATSPPGSRALGPATVLGPRAPDGQDLAVGQARAASCAQKPTPPPSAGAPALAEVSEATHLEGVRRPQHPGDALESKQEDSRRETVNASDLAML

SEQ ID NO: 371 - protein, 10 aa, Homo sapiens
GMFQMALWSL

SEQ ID NO: 372 - protein, 49 aa, Homo sapiens
IRSKCRYMVFNRCAISAAKSAHGCFTGLYLCCTIGPWPCCSLDGPRHSL

SEQ ID NO: 373 - protein, 48 aa, Homo sapiens
LWLTVIPALCPMLKFNFTLPTYMKPRGNIILQKKLMNNFCRQRIFLHK

SEQ ID NO: 374 - protein, 43 aa, Homo sapiens
MQALFIGFRLLAGATTLLGMLVHLQPASINWQWNGTNGTNCKV

SEQ ID NO: 375 - protein, 41 aa, Homo sapiens
QFSNTGGCSQSPLLSHCYLRWTTRHYLNQREQAFRKHIDGA

SEQ ID NO: 376 - protein, 38 aa, Homo sapiens
FTKDLHSTLPRLCTKNKRKLGKLCGARTVQNGGPDASL

SEQ ID NO: 377 - protein, 36 aa, Homo sapiens
DQQELHRYDLLEFLMGQQLTHHCLQTQSLASSHSLL

SEQ ID NO: 378 - protein, 34 aa, Homo sapiens
EKKMKKEVIIKTTQIVNLHRQIILGGGGKDPLKP

SEQ ID NO: 379 - protein, 32 aa, Homo sapiens
VKMAYLTVAFCWINVHLQDHHLHHTLPCQRTS

SEQ ID NO: 380 - protein, 23 aa, Homo sapiens
HRGLLSITSPLTLLPQVDNKALP

SEQ ID NO: 381 - protein, 21 aa, Homo sapiens
LITAYKLSLWPAATACSDQSA

SEQ ID NO: 382 - protein, 15 aa, Homo sapiens
LNFLLLCVSYQQEIF

SEQ ID NO: 383 - protein, 81 aa, Homo sapiens
WEKPITMWVLEPVTKSITSTQLFIQRLITLLPLHHLQPFQQQHLLQNPLSRQPQTVLPALTALTVGYTQLMEKGWKNLRAP

SEQ ID NO: 384 - protein, 79 aa, Homo sapiens
VTSTSYWKIIQKHYLHTRGTTVYSLTTGRMLPFYMVLVWSTSIIMHFSGQLKHFRRCFMLIPAFVEPRKFIYDLGLCSK

SEQ ID NO: 385 - protein, 67 aa, Homo sapiens
ISWEIKPPRKAMLFSISKSPWKQILILASPGISSEGAIQVLGKFRMPLYLTGSLLINQKQVQIHGVQ

SEQ ID NO: 386 - protein, 65 aa, Homo sapiens
PAAQRSRGKTNYLTPLRGFTKVRVHIRQVLMVNDLSLPLGLPSISRQLALVFRIRTDIPPCLAIQ

SEQ ID NO: 387 - protein, 61 aa, Homo sapiens
MQLEAKVVVIPLHLQHELSIYRLSCVTFHKVVYRIKLNYFLVLRRRGAYQFPQSLPPGRVP

SEQ ID NO: 388 - protein, 281 aa, Homo sapiens
PVPAAQRPPGGAGHARPGHLHGQLRHQQHRGHPGERGPRVDVQAAGAAATPAAAPTGPAGPAGAPAAAGGAPTAAGGTPAAATGAHADHAEQRAGPVPANAHQDGAAEPQPLQRAAAALAPTDRLQPLQPPTLQPLLPAHHPLTVRLHRPPELQLLLQPRGRPGHRPLLHLHLHEPRSAPHVHPHRRHLWGPFHPADPQPPALGTTRLHTAHSTLRRPPTKGEDGRDDPKNNRRKRGPTRIPFGHLCFFVFLFCFVFSSSSSSLKTFKLKATRTQISKTQT

SEQ ID NO: 389 - protein, 49 aa, Homo sapiens
PTSRRRACPAPPAPPCPRTPRARPARRAPARTPRTRGPRRTRSPRASPI

SEQ ID NO: 390 - protein, 43 aa, Homo sapiens
PEARGAPLARGGQTAPYRLPRRGHRRAEQRRHLQHRDLRCQRV

SEQ ID NO: 391 - protein, 33 aa, Homo sapiens
ARCTPPASTRGNPRAHRPHPPPPKPTCSRARLT

SEQ ID NO: 392 - protein, 103 aa, Homo sapiens
AATSSPTSRPSMSTSLTSTCRPTATRGCRPRTARSPTRAATASAAPRPPRRARATCGCPSSRRRRHPRSSPHRPRRPRRRPRSRRRRPHSSRRHPRSSHRRTR

SEQ ID NO: 393 - protein, 25 aa, Homo sapiens
SERGAPCQRGADSPLSTSATWTSAS

SEQ ID NO: 394 - protein, 66 aa, Homo sapiens
APATTASSSSTRPNRSPTAPSTSHTTAPPTRPSPAHSTTTPTTRTPAPTTATRQARAPASTPPSPT

SEQ ID NO: 395 - protein, 53 aa, Homo sapiens
SSLMYHFLQQAMVFLDIRILVMVLQKAQHSDHSGVVIVKWLFLEVVCGNLSKI

SEQ ID NO: 396 - protein, 51 aa, Homo sapiens
ILIPNLQEQLGPIQTLTLNLLELPGLLLLTHIVSSPKPQDHLHKLTCLLHL

SEQ ID NO: 397 - protein, 45 aa, Homo sapiens
IFCPSFKGFFPAWNHIKANISGPILPTPRNSTTCCRFLFPIFRNS

SEQ ID NO: 398 - protein, 36 aa, Homo sapiens
IISVYLLNQKKRNKKTKLWFSLINIHHRKNPLLPMR

SEQ ID NO: 399 - protein, 36 aa, Homo sapiens
MNLLPILQGLFPSLEPYQGQHLRTHTPNPQELHDLL

SEQ ID NO: 400 - protein, 108 aa, Homo sapiens
VTLQSSGGSMFSVMRCDRLLASCNEENGTIPFAWVASSSTQLVSCFHSRCKHSILLKHSSLWAMKPAGCTGALAMPIGAAATCAPLRRRMGAQCLSSGLWNKAMKTWF

SEQ ID NO: 401 - protein, 29 aa, Homo sapiens
IIQLDFLSIFHHRACQFSSTTYWAKHILN

SEQ ID NO: 402 - protein, 103 aa, Homo sapiens
CRRRRTRAWSSRSRRHHPPRSLEPRPRAPQPQTKDLGAGLAKMALPLSREPERNLEVGGKLQWKMRTAWMGWRQQKQKRLWKQKSKNNLQKRMLKQKWITANS

SEQ ID NO: 403 - protein, 101 aa, Homo sapiens
MALLDPVLISHIILCHLEADWELSLQLHNPLILMPGIKIQPLIQWQVILTTLGHHQLPLWKEKMTQCRMPREARLSGRKRRLWVKWQLLPQFSTPILISPT

SEQ ID NO: 404 - protein, 25 aa, Homo sapiens
NWKRLRQSPAQAKRSLNWRNRMVVR

SEQ ID NO: 405 - protein, 92 aa, Homo sapiens
IRIAWPSFRPLQTSNQSIQGMVKWMIVEKENLWIVMENQNLVLSGKLWMMKLREWKEQMVSKREKGNHTDQVLVDLWCGKEVELGKGKPKDL

SEQ ID NO: 406 - protein, 77 aa, Homo sapiens
LRSRTQLKDCKLWGLKCKVVLDVATSCQKQMEEVKPRNSEANGLRGRVRKQHLAQRKGKRTKRRNKLCTLALTRLPT

SEQ ID NO: 407 - protein, 69 aa, Homo sapiens
DSGRSYVKSFSSSNSRRRLQVDRRRGHRTHPQCLIQGLFNTGNQRMLTRLSPDPHLPILGTLGLLLPLL

SEQ ID NO: 408 - protein, 68 aa, Homo sapiens
FVAVLAKEQKEDYLPVLSVVSVTIHTVSVLRSLKWFLAKVGGVLSALCVRPVGRQLTQEDSCCVMTVT

SEQ ID NO: 409 - protein, 60 aa, Homo sapiens
PPALSWCYSQLTSPSLTCGMRRTCITLALESLTPRRESFRVCSGLCSRTPVLALCTLAAD

SEQ ID NO: 410 - protein, 59 aa, Homo sapiens
TMMSRTCHRQTLPFRMKPALPLLKHLSLSQPYLLLLLSHRNGTVPPLLFLCPQFLLLHW

SEQ ID NO: 411 - protein, 57 aa, Homo sapiens
KYSSVPCGNHQCYRGTLFLFPRLLRANKSDISSGHLFLYKRQHGFHNNAWLLWHYKD

SEQ ID NO: 412 - protein, 54 aa, Homo sapiens
CRSPSTSPSPTCSTRRTCVALAPGSSTPWRVSCRVCSSPCSRTPVLALCTLAAD

SEQ ID NO: 413 - protein, 49 aa, Homo sapiens
PQTSPSLQQGQSPAQLPLCPQLWEALKIQEKKNSELPLWIFHLQLHQWR

SEQ ID NO: 414 - protein, 129 aa, Homo sapiens
WNASDHHKDVKPGSTRKFHVACPSRGDGEQSSRHIPRKPRNVYHSQNHELQGTQHQPRDQVHCEKFSLEDSRNNCSHGDHSGTSHPSVHSPRKWQHQHLSPAHRNHITNQVTNRKYVGYRKGLPLPIPT

SEQ ID NO: 415 - protein, 42 aa, Homo sapiens
PSPPKQVILGHPHKVPLPWTHQAEPPGQELTQLQLTDLHTQG

SEQ ID NO: 416 - protein, 42 aa, Homo sapiens
STRRTCIALAPGSSTPQRESCRVCLVPCSRTPVLALCTLAAD

SEQ ID NO: 417 - protein, 41 aa, Homo sapiens
PLPPKQVLLGLHQGVPLPWTLQQLLCQGPTQLHLKDFHTHR

SEQ ID NO: 418 - protein, 41 aa, Homo sapiens
QTPLVNQLQQFHWSRILHRPAQQFPGQLPFFSIVNQTPHLQ

SEQ ID NO: 419 - protein, 41 aa, Homo sapiens
RPQICWHLWPVYLQTWAAPHIRYRLLQKTLKIQRKCILPQT

SEQ ID NO: 420 - protein, 123 aa, Homo sapiens
VCIAQYPSLGHINHTFPGRDSFNCDSGIPILRGDHSHGHGSWECVMDDNSPCGRNQLCVFPDVFTCHDIPFSCFLHITTEHPLLSSSCDCTSYFCSGDNHRCVGHNKPRVCNQFTSKFEQHHS

SEQ ID NO: 421 - protein, 38 aa, Homo sapiens
GCVMAKPAVCGKKQPSIFPGIFIFSNLTFATLFHTIWE

SEQ ID NO: 422 - protein, 117 aa, Homo sapiens
WRPASLKRPALPQKKALSFLVCPLVLLLRSPGQKPSLLAEHPSQALLNPQCHQTPPWKPSLEFLPPSQGKNQQTWPSPPKQVLLGLPRRVPLPWTHQAQPPGQELTQLQLRDFHSQW

SEQ ID NO: 423 - protein, 116 aa, Homo sapiens
PMTLKSWAPTPWTGTVSMSMVSPIRALCPPPALLGPPQWISEPQGLHPPSPAPQLWLLALSWYHSPSTSPSPTCSMGRTWVTLAPGSSTPQRGSCRVCLVPYSRTPVLALCTLAAD

SEQ ID NO: 424 - protein, 35 aa, Homo sapiens
PPHQGRPAPPRRSTQPQSQALFLTRHSLVPRLRTP

SEQ ID NO: 425 - protein, 114 aa, Homo sapiens
PMASKSWAPTPWTGTVSMSMVSPIGALWPPPALLGPPQWTLGPQGLHPPSPAPQQLFLSWCRSPSTLPSPICSMGRTCVTLAPGSSTPQRGSCRVCLVPCSRTPVSALCTLAAD

SEQ ID NO: 426 - protein, 114 aa, Homo sapiens
PMASKSWVPTPWTETVSMSMVSPIRPLRPTPALLGPPQWTLGPQGLHPPSPALHLLALSWCHSPSTSPSPTCSTRRTCITQAPGSSTPRSGSCRVCLVPCSRTPVSAFCTLAAD

SEQ ID NO: 427 - protein, 114 aa, Homo sapiens
PTASLSWAPTPWTGTVSMSMVSHSGALCPPLAFLGPPQWTWEHLGLQFLNLVPRLPALSWCYSLSTSPSPTCGMRRTCSTLAPGSSTPRRGSFRACSGPCSRAPVLALCTLAAD

SEQ ID NO: 428 - protein, 29 aa, Homo sapiens
AEVLRMCHGQARCLWKKTALHLPWYLHLQ

SEQ ID NO: 429 - protein, 22 aa, Homo sapiens
PSIFPGVFICSNLTFATLFHTI

SEQ ID NO: 430 - protein, 195 aa, Homo sapiens
SAHNSTRHLHRNDHQALHLPHHDKICRNDRHHSNNYSWGYITGYPSLGHINHTFPGRDSFNRVSGIPTLRDNHSSEQNPWRCVMDDNSPCGRNQLWVFPDVTFHDIPFSCFLHITREHPLLSSPCDCTSYFCSGDNHKCIGHNKPRARNEFTSKFKQPHTGETDHLQRHCAHRSHACFHAYKHCSGQRGDLHFWT

SEQ ID NO: 431 - protein, 17 aa, Homo sapiens
GPCSRTPVLALCTLAAG

SEQ ID NO: 432 - protein, 12 aa, Homo sapiens
NQFTSKFEQHLS

SEQ ID NO: 433 - protein, 74 aa, Homo sapiens
PSLCERNQPSILPAVFTCRDLTSSCFHHIPSTYPPLSPSCDFTSHLWPGDNHRYLGYKHRTWNQFIFKFEHHLP

SEQ ID NO: 434 - protein, 74 aa, Homo sapiens
SILCGRNQLCLFPAVSACHDLTFSCFLYISRGFPFRFSSCDFSSQPWPGDNHRQDGHKQRTWNQFHFKFEQHLP

SEQ ID NO: 435 - protein, 69 aa, Homo sapiens
DTGHFGSHHRYRDYSSFHKQSSDQYGDCQFSTCTAFHSPSQLRTIYSHISNGSCLQHGGRSCFYINTWF

SEQ ID NO: 436 - protein, 66 aa, Homo sapiens
TFLFSDVFTSHNFTFSCFLHITREHLFLSSSCDFTPHVWLGKNYRYVAQKLRTCNQLTCKFEQHLS

SEQ ID NO: 437 - protein, 61 aa, Homo sapiens
LLDLGRQTCPWTPAQSHQQIHLLLLGPLTFYRVPRLISPLLQKHHPQTGLQPHSILKFQWT

SEQ ID NO: 438 - protein, 51 aa, Homo sapiens
LGTDPEQPPDVIGGYREGQLVGGTAPVLVEDAGSGLDQLPSGEEQVRRKRH

SEQ ID NO: 439 - protein, 41 aa, Homo sapiens
WLQPVRLATFLATTSVRCTARRTPPWPLFPLLPPLGPMTWY

SEQ ID NO: 440 - protein, 112 aa, Homo sapiens
GTTTNGRSWNGWMAGDSSTSLAKTQAAGRRKRFSRVGTEGWNYTRDQTHGPLEACKPSWEDRQARWPLHWGMLPAVLWREADVLVYCQPSSWDSETMASPPHPPLGITSPGV

SEQ ID NO: 441 - protein, 30 aa, Homo sapiens
SGRIGMKASSSSCAPRLWPNYGAKRKRTAT

SEQ ID NO: 442 - protein, 98 aa, Homo sapiens
TQGPLTRAAPLPRSCWTTVSKPAPTTPAAVAQEPPPLAALTSPPQGLVLLGAPTPQTPVEVTWTWIPLMASSSPAMVFVTARRGIPSTGSGNEAGPES

SEQ ID NO: 443 - protein, 169 aa, Homo sapiens
RRLQVPALRGCGPTMGPKEKEQQHDLREAEPGHEVLLQTGDPGTGGWPATRLQVWQKLKRLEGGRGSPESELRVGTIPGTKLTDHSRPANLPGRTGRPDGPSTGECSQLCCGEKLMFWCIVSHRPGTRRLWPRLPTLLLELQALGFEADFIAASVSPFIWCLLKPSLRH

SEQ ID NO: 444 - protein, 65 aa, Homo sapiens
LQEGGSQAREAETRPAPKAEQRVLGLSRGQEEQARAQRHPPVGVHPGHPHPPGAQRGPHEVGESA

SEQ ID NO: 445 - protein, 55 aa, Homo sapiens
ITLLVFLIITMLILATDIFQNLRSIASVDSHLKNKQQNNCQQPYFIKSSQSIRNH

SEQ ID NO: 446 - protein, 48 aa, Homo sapiens
TWSVSSWNWRKLSNSALLRNWSGNVRKFKGSENKKRSWFRKSWRSCSL

SEQ ID NO: 447 - protein, 46 aa, Homo sapiens
IQPVYTTTNPNRISTSSSDKSLHTIPVLFPCSSYPSTHLIHSTVSF

SEQ ID NO: 448 - protein, 46 aa, Homo sapiens
TESLILWKGSLQNFERNKQSLMKKKRRLMLSYDTWKWELTGGKRPY

SEQ ID NO: 449 - protein, 39 aa, Homo sapiens
RLVIHLTSGQIPQYSWLLPHPNPPKSFTHPSHHFHQAKP

SEQ ID NO: 450 - protein, 37 aa, Homo sapiens
HHFWPQKKYYRPTKIYGIFSWHRTGHIRKYHTLSSAG

SEQ ID NO: 451 - protein, 34 aa, Homo sapiens
IAFPYLPTFPTLQQVFTKIFQIPHRNLCSYYIAI

SEQ ID NO: 452 - protein, 32 aa, Homo sapiens
KYKKFINCPQLFHYTHQQMSNLLCRKKVAKRR

SEQ ID NO: 453 - protein, 30 aa, Homo sapiens
SSTRFICENICDEYFYPKKGDQEKNKSMQT

SEQ ID NO: 454 - protein, 27 aa, Homo sapiens
QINILQSHHRKKQVCILTKSQNWKWKA

SEQ ID NO: 455 - protein, 26 aa, Homo sapiens
PESQKRREQTATQSSAQTTWPSFAYY

SEQ ID NO: 456 - protein, 23 aa, Homo sapiens
SRKKQEYADMIESLRLMKLFDSV

SEQ ID NO: 457 - protein, 90 aa, Homo sapiens
KSSFQLHTLHLERPLVRKNLHLSYHLAVLLFPLFQLNLAHSLEVLLWIYQLNLLPLLPLPLLLLLHHHPLLPHHFLHQLHLNQLFFLKKS

SEQ ID NO: 458 - protein, 90 aa, Homo sapiens
KVQSYLFWKLKQVHLLMKSQKRKHNPMKFLLNSLKTKRKLRVYLKPWKLLFQKRRSKRVKKKGKTLLKKIANKIFLPARTIKRSLSLLMT

SEQ ID NO: 459 - protein, 16 aa, Homo sapiens
SCGKGVCKTSKETSRA

SEQ ID NO: 460 - protein, 80 aa, Homo sapiens
KKKSQPLKTKSYSQRQKHQPQKNRNMTYLNLKYKLLKKSLKAEWLQRQCKKGNNHRPRWKVYHLAHLRVYLKKMIRQPKQ

SEQ ID NO: 461 - protein, 13 aa, Homo sapiens
RKKATPRRKKANP

SEQ ID NO: 462 - protein, 106 aa, Homo sapiens
KRNRKENQVQRQRNKLHWHLSQSKKERREIPGLIQNQIGAVTKVILMSLHEKQSHGEQQQKQNSQWIWIQMKISQILMKKLMMKILSHQMLVHLRPKLPQNLVTKN

SEQ ID NO: 463 - protein, 30 aa, Homo sapiens
RRQQQKVSLPPPLPVPKKGLPQKELKGIQL

SEQ ID NO: 464 - protein, 25 aa, Homo sapiens
LMLRTTNKGTQKCLVLESQLIRKTI

SEQ ID NO: 465 - protein, 18 aa, Homo sapiens
DGTQALQWRRLYMYHLSA

SEQ ID NO: 466 - protein, 79 aa, Homo sapiens
QVVEMAMEPNCVTYSVPNLLWKQPVENTRKCSNRHGWIIWEELVRWNSSPSMEKIIHVSPFSLICLSLKCKAWTKILLH

SEQ ID NO: 467 - protein, 71 aa, Homo sapiens
ILVSLKSLILPKPRIAAKGSHPLLMILTLILRKLFRKQSQARNPRGRVMTSIWTLTQLWLLGQNLYGQRNL

SEQ ID NO: 468 - protein, 64 aa, Homo sapiens
KERVHQICGKKTWLHLLKNWRLLKPRKNKMNKSDFLGKGGRPRGKKHKWLKFCLLRVVKESFHE

SEQ ID NO: 469 - protein, 125 aa, Homo sapiens
LTAWSTCIARALCTRTSSRGTCCSPPVAPSKSPTWAWPRHCTRSRRTTPAGPARAPRLSSRPRLPTAWTPSPASRWTSGRLGSPSTTSPRVCTPSKGTTSTSCLRTSGRGATPSRATVAPRSLTC

SEQ ID NO: 470 - protein, 41 aa, Homo sapiens
STSAHPTEPRHQGPVAQHDCGAVLGGPARRGRGRGPLRHRG

SEQ ID NO: 471 - protein, 31 aa, Homo sapiens
RRCWTRRRCAGGPSRSSRRRSCEGSPTGRPT

SEQ ID NO: 472 - protein, 95 aa, Homo sapiens
PGHCAQGHQAGEPAAHHRWHPQNLRPGRGRGTAPVRGGRHLPDQPGLPGFPAARDCQRPGHLLRLQGGHLVGWGHPLQHHHGSVPLRRGQHLQVV

SEQ ID NO: 473 - protein, 12 aa, Homo sapiens
WGTCWGKALTAR

SEQ ID NO: 474 - protein, 54 aa, Homo sapiens
APWRTRRPTWAAAARAAAATPRRSSAATRTPSRPTRTSRSSPWPSSRRPARCSR

SEQ ID NO: 475 - protein, 142 aa, Homo sapiens
AGLQGIRTGTAILALRLYVARQPASRQRLGDHQEPHRALSPGAGVLPRCVFQTRPKHFLAPGTGGFVWHSHAGSKREKINSKQNHTNQTVNSIIKSQQLFLFHFSCTTFPPVQKTVTLLLYSKFIVYITTKTTPNQFFSCEV

SEQ ID NO: 476 - protein, 50 aa, Homo sapiens
KGTPTTPSTTRSPSTTSCPPRSSSISWTSRHTNRHCNTRLTALRCPPACL

SEQ ID NO: 477 - protein, 126 aa, Homo sapiens
ARSTSGSWTSSPITGRTSSAGRTPSATRCPSMTASSRWHAPRTSRARAPTGRCTRTPATCSRTAATCAARSASSARSSRGPAAGAGAEAGAAAPRAALRAARTPLAPLTPAPTRPSIGVCTGRPAS

SEQ ID NO: 478 - protein, 214 aa, Homo sapiens
NQRLEQLLRRHAGGLLLRPGQQHELRPGLHELHEHLHDHEHHDYERQHDPGVLQHVLCQPGPRGRPESRRSSRHAGGLGGRHEQHDCGRRDGHGYGAEPERHGRHGCAAGGLHEWPGPLRGRHEPVHEPHGVRAVQPGPQPRGRRRRRQDVQAQLPARQAALLVHLAHHHGHPAGAQQDAHAERDLPVDHGPLPLLPAEPAALAELHPPLAVLQ

SEQ ID NO: 479 - protein, 13 aa, Homo sapiens
TLPSSRDWGVCLA

SEQ ID NO: 480 - protein, 43 aa, Homo sapiens
PRWWRWTATRARTPGCRTSCSRPRSPGCSACGRTMARCAPPGC

SEQ ID NO: 481 - protein, 108 aa, Homo sapiens
GSATLPSRGWWCWSRTMASLRARPPPRCTCSWWTASPSPTCCSRRRHRPRPRPTCSPSTWWWRWPRCLRSSSSRCSCSWRCGCAGGAGRPRWVAARCPRAPFQGRWWT

SEQ ID NO: 482 - protein, 103 aa, Homo sapiens
PCWSPTSMTTPPPSPKPPTPCSSARTTAPPCTSAASAPQTETRAPTPRSPTRCCRPRTRTCPSPPWSPSTRTTATCSLSSRWTTRPCRRSSSAWAPQTAAPRR

SEQ ID NO: 483 - protein, 24 aa, Homo sapiens
GGPGSFPKEKKCICSSIGRPGICC

SEQ ID NO: 484 - protein, 316 aa, Homo sapiens
QRPRLHPNLLHPVRPREQQPRPAHRQRQRHRQRLGHQRPGHLLAAAAPGPAPAPRLPGLHQRGQRPPVRSPVAGLRGPAGVRVPRGRRRPRLPGVEQRGAGARAGAGRQRQLALRAVPAAERLRALHRAGAPGGRAGLPGDQGGGGGRRLGPERLAVVPAAQGHGARAVRRVGAQWRGAHRQAAEGARRCQAEAGGAGQGQWRASALGHRHAARAPGGRLLPALPAAPGGGTGPGPGRLAHRLPGGGVGLGVFALPLLGAPVRGGAAVQEEQGGLGGSLLGARGPLSRADGGRERHRDPVPELPVRGVSDWRLRDK

SEQ ID NO: 485 - protein, 52 aa, Homo sapiens
VSAERCRPLQNTRTMSTWKGLRKPRSCFYSTSTASSMSISSVGESCTWQPCH

SEQ ID NO: 486 - protein, 41 aa, Homo sapiens
LPPGRITALQLKPAGFRRRYRAILQPVSRRHITAFSVQRPF

SEQ ID NO: 487 - protein, 41 aa, Homo sapiens
LRGRRLLKKLTEGSQASPVANPSINLRSFTHFLKMWWKKRT

SEQ ID NO: 488 - protein, 39 aa, Homo sapiens
RAFSQNCLTPWSRITCRSTWWKHTKSTTGSRSCMPLRRY

SEQ ID NO: 489 - protein, 97 aa, Homo sapiens
CVEILLVQMTYFFLSFSPKPVNLPIVEATTLFYLNYQSDCTRSGLNCLFFHTIPPLASERAGWFMGTLFFIQPNVRPLWLCYVPFFVKCRILSLFSL

SEQ ID NO: 490 - protein, 392 aa, Homo sapiens
DLISALWTPSQPRAPTRQSLNSLSSSAPSSSTIGPSPSPPAPGPAPPLPWLPPSPSSLPRLSQVSRRPHSRLHPPPSPQCSHCFPPSFKPNTRCEPPRPGATGEPVLSLTGWHLALNKTKSTGDRGRGKWLSPLPSQDLSGSTSQWYHRLGCQVPWAWRCRPELAWTHLRTELGRQWLQCPPSVPWTTTPRSCSHQPPGASLCLYRAHGRDSALAFAGEEDALRFRVGLATPEENTSCWSVSSHLPSAHTPKVRVQPGWRPPWERVGHGSATTRYLLRALALQIRTTEDSFVPGPRECGTPRFIPTVPLHSLPETFPGKQRNTRRKNGKTLPVIKKEETTERKLQTSRFHSVPASAGREGGTQVELTLVFVAAKPGCLELWPEGLLGSHSPT

SEQ ID NO: 491 - protein, 88 aa, Homo sapiens
TLYPAVPLLLLQSAHHRAPRRQAQLPLCRGFHRPLPHFHACHKSAVAPTVASTHPPVPNAATASLPASSRTHAVSHQDLGRQENRSSL

SEQ ID NO: 492 - protein, 16 aa, Homo sapiens
RCGGKKEHNRGYSYVR

SEQ ID NO: 493 - protein, 78 aa, Homo sapiens
SRLLICTIMLPRPVAPPKRCLTPPGQDHRSATQTCRIQKKISSHLTACFEKTHHCLLCPKTILSSLWNWREMMGCLSL

SEQ ID NO: 494 - protein, 167 aa, Homo sapiens
WQESKMSEFPPTTSVWWDYLGPRRKRASVGLESLVCATASCARVLTSFTWTIPPSSAPVTLEGEWSIMTTFSTGEKLAAPWRIVWNVRCTLWSRLNLLMIRLFNLIEARPCSPISRELLRPSLHQLKNSCTFALTSWGWSRTLSRNKCQTESCWLMVFFLVLMLAGA

SEQ ID NO: 495 - protein, 153 aa, Homo sapiens
ASIRVPPSHASMGARVLSTTEALFASVEDYILVRGVSLVHTAKMNPVRMAEHALTVWMAPFVSVIRVLGEKGVRVISTSALETLACTGPSVRTRTAPITATAATSTGDVTARMLRPTSMCPRRGTLGWRKELESLCLLQGYFYWWWCLFSAVR

SEQ ID NO: 496 - protein, 58 aa, Homo sapiens
FKPQLGGIVIKAIANGWLRCKGVFPQSENHSYRWRKFCHTIIYQHNSGCQSQAGKLAV

SEQ ID NO: 497 - protein, 47 aa, Homo sapiens
PFHWCREYVRKPGLRTDASGLYSEDSCIRLGLAVPPGSRSPCYNYSQ

SEQ ID NO: 498 - protein, 45 aa, Homo sapiens
MTTPLCLSTVNMVPPCLRTFLLELKFFKCMQQVGILKQMQKSPTQ

SEQ ID NO: 499 - protein, 42 aa, Homo sapiens
NATLQGLWSMSATRMTTPRGSPLPPTKGGFMNRQPLAQLCCR

SEQ ID NO: 500 - protein, 38 aa, Homo sapiens
ISGPVLLKGLQSLKFLQVMPMRAPMPTSPMPLKQTLKV

SEQ ID NO: 501 - protein, 34 aa, Homo sapiens
LSRWTLPTSMIIHHSLNNRFMKPELASTPLMGIS

SEQ ID NO: 502 - protein, 110 aa, Homo sapiens
IRTFTQTYHPRCLSGLFPTPRVFQVTQETIWTEIPSKDLLSQSIPNSALLTPSLCTGTEKQWRSAAWRQTCLPHPLQTPLLTATPSRSLAGTLTMTQKWWILIPVFPRSL

SEQ ID NO: 503 - protein, 24 aa, Homo sapiens
KHLKKILMWRREQRSGCRCWIQMT

SEQ ID NO: 504 - protein, 22 aa, Homo sapiens
QMGSSRRWPTSQCISDKSHRRC

SEQ ID NO: 505 - protein, 91 aa, Homo sapiens
PPTRMRAPMQKSPTASKTGMSMANFSSNRKLEWFRPRGFQQLENMIFFQLRQLTMVALKSHQPPDSILNGSPSPNRPWSPFHLKNHFLPLL

SEQ ID NO: 506 - protein, 14 aa, Homo sapiens
YPCVQPRHLHDSHQ

SEQ ID NO: 507 - protein, 66 aa, Homo sapiens
YLWSLLAYPFGLTSLVATTTVTSMWTRELEPSLLPNLLMQNRSQTTTSQSRLQMEPPLSSLRYSSK

SEQ ID NO: 508 - protein, 151 aa, Homo sapiens
LTRPQANQPARCHGEASLFQVCRKWTLCLRLEASAQLCQGRHQGKPGAASPGNPQVPGTEASPPQGITLQEPSSGSRPRCPACSGRRSSAFCICSSRRAQTQGARQRRGARDTGFTQPHCQGRVFPHQVGLPHSWLPLESRLTFPSTRVST

SEQ ID NO: 509 - protein, 293 aa, Homo sapiens
TPSKPTSPMPRRSQPLPSLSQMDSLPSTRSFSTALPGKTSRKTWSCKPGEPTGAWDRSQPSTGHHPARAQLRKPPSVPSLLWKAQLGLLHLFQSASTDSRGQTTPRRPRHWLYTTPLPRPCLSTPSRPSTLLATPGKPAHLSFHQSFHIKSHLQRGLGPFPLTCTPQSQSTRLTFTQSTGWPPSTRLTCWLGARLSVTHPCCQSTEPKTRDTSCLTRGRSLSTWLHLQPHTITTGFSSNIPLTCRFLTDFTGQSLHFPPMVSDSHLSLASPEIRALTCLKKPPWSIQPRVLPG

SEQ ID NO: 510 - protein, 45 aa, Homo sapiens
NLIYKGAWGHFPLHAPHNPRVPASLLHRARAGHHLLALPAGWELA

SEQ ID NO: 511 - protein, 42 aa, Homo sapiens
VSSKSGSQKSHITSPGLQESPSSINVSNVPLLAMRSHIFLIT

SEQ ID NO: 512 - protein, 73 aa, Homo sapiens
RLLQGWAERHGRVQNEPPRRECSHGLPREAEPHRLHADEPDLRRPVRPLQQGSLQRTGKTLPARAKPHSLQAC

SEQ ID NO: 513 - protein, 43 aa, Homo sapiens
NHRGKGGLSGNLRRIYWKEKNLASHTKAPATSASSCCTRFFEN

SEQ ID NO: 514 - protein, 38 aa, Homo sapiens
NILEGKKSRLPHQSPGHLGLFLLHQVLRKLKQMLNNKL

SEQ ID NO: 515 - protein, 33 aa, Homo sapiens
GKNYMNITLSFKKKVENMIDYMKNIPAHPRKSK

SEQ ID NO: 516 - protein, 33 aa, Homo sapiens
TRPYPAEKDERPILDVVDSKRCSAKEVERVVGQ

SEQ ID NO: 517 - protein, 28 aa, Homo sapiens
MKNFEIQQTGPFWYEMRLLKCMVIILLH

SEQ ID NO: 518 - protein, 16 aa, Homo sapiens
RIYPHIPGNPNEKDSY

SEQ ID NO: 519 - protein, 66 aa, Homo sapiens
TSGWAMKTLKTNIHWWKMMKICPIMMRRHGMLEAATETKLKTCCEGSEMALFLSGRAVNRAAMPAL

SEQ ID NO: 520 - protein, 58 aa, Homo sapiens
LCPWTDRDQHWRKTRIAPRAGTRQLQAFSVPRGSGHHSWTPGVKQRRKAGIPPRAIGK

SEQ ID NO: 521 - protein, 58 aa, Homo sapiens
VCPWADQDQHWTKTRIPPRAGTRQLQALSVPRGSGHHSWTPGVKQKRKAGIPLRAIGR

SEQ ID NO: 522 - protein, 58 aa, Homo sapiens
VCPWTGWAQYWRKTRIPPRAGTRQLQALSVPRGSGHHSWTPGVKERRKTGILPRAIGR

SEQ ID NO: 523 - protein, 58 aa, Homo sapiens
VRPWTDRDQHWRKTRIPPQAGTRQLQALNVPRGSGHHSWTPGVKQWRKAGIPLRAIGR

SEQ ID NO: 524 - protein, 142 aa, Homo sapiens
EMAPDTPGPIKKTELVMGTLQTAPDNQALVTHRLPLVDRLHHPMNRQDQVQEKDMDPTTSSQQTAPDTQALGTDKLHLQSETVDTEGTVVVRPVTMRDIQKTQTHSQCQPTDRLGPISRATKSPHVAGQGKRLDIQDLSSTR

SEQ ID NO: 525 - protein, 44 aa, Homo sapiens
DKDPTMSRHETTPGTQHPKMVRTPFVDTRGQAEEEGRGPTTSNR

SEQ ID NO: 526 - protein, 260 aa, Homo sapiens
IGLDTQVPITATPHPREGLMPPMGSQDPEVQADKHEMRNNQETAPGTQGHVIMKLPLRLTALDTHRWARDNHRGPGQVGTRDPVLARTVTVRDTQKTLRGGLGLLPETIMDLLRSSQEMAPDTPGPITKTELVMGTLQTAPENQALVTHRIPLVDRLRHPMNRQDQVQEKDMDPATSSSQQTAPDTQALGTDKLHLQSETVDTEGPVVVRPLTVRDIQKTQTHSQCQAMDRLVTISRATKSPHVTGQGKGLDVQGLSSTR

SEQ ID NO: 527 - protein, 260 aa, Homo sapiens
IVLDTQGLITATPRPRKGLMSPVGSQDPEVSADKHVMRNNQETAPGTQGRVTMKLPLGPTALDTRRWARDNHQGPGQAGTRDPVLARTVTVRDTQKTLRGGLGLLPETILDLLGSSQEMAPDTLGPITKTEPVTGTLQTAPDNQALVTQSLPLVDRLRHPMNRQDQVQEKDMDPTTSSSQQTAPDTQALGMDKLHLQSETVDTEGTVVVRPVTVRDIQKTQTHSQCQHREKLGPISRATKSPHVASQGKALDVQGLSSTR

SEQ ID NO: 528 - protein, 259 aa, Homo sapiens
IDLDTQGPITATPHPREGLMPPMGSQDPEVQADKLVRTNNQETAPGTQGHVTMKLPLGLTALDTHRWDRNNHRGPGQAGTRDPVLARTVTVRDTQTTPRGCLGLLPETIMDLLGSSQEMAPDTLGSIKKTEPVTGTLQTAPDNQALITQSLPLMDRLCHPMNRQDQVQEKDMDPATSSQQTAPDTQALGTDKLHLQSETVDTEGPVVVRSLTVRDIQKTQTHSQCQPTDKLGPISRATKSPHVASQGKALDVQGLSSTR

SEQ ID NO: 529 - protein, 259 aa, Homo sapiens
IGLDTQGLITATPHPREGLMPPVGSQDPEVQAEKHMTRNNQEMALGTQGRIIMKLPLGPTALDTHWWARDNHQGPGQAGPGDPVLARTVTVRDTQKILRGGLGLRPETIMDLLRSSQEMAPDTPGPITKTEPVMGTLQRAPDNQALIMQRIPLVDRLHHPMNRQDQVQERDTDPTTSSQQTAPDTQALGTDKLHLQSETVDTEGPVVVRPVTVRDIQKTQTHSQCQPTDRLGPISRATKSPHVAGQQEGLDVQGLSSTR

SEQ ID NO: 530 - protein, 259 aa, Homo sapiens
IGLDTQGPITATPHPREGLMPPVGSQDPEVPADKLVMTNNQEMAPGTHGRITMKLPLRRTALDTHSPARDNQRGPGQAGTRDPVLARTVTVRDTQKTLRGGLGLLPETIVDLLRSSQEMAPDTPRPITKTEPVTGTLQRAPDNQALIMQRIPLVDRLHHPMNRQDQVQERDMDPTTSSQQTAPDTQALGTDKLHLQSETVDTEGPVVVRPVTVRDIQKTQTHSQCQPTDRLGPISRATKSPHVAGQQEGLDVQGLSSTR

SEQ ID NO: 531 - protein, 259 aa, Homo sapiens
IGLDTQGPITATPHPREGLMPPVGSQDPEVQAEQHVMRNNQETAPGTQGHVTMKLPLMPTSLDTHRQARDNQRGPGQAGARDPVLARTVTVRDIQKTLRGGLGLLPETIVDLLRSSQDMAPDTPGPITKTEPVTGTLQTAPDNQELLTQRLPLVDRLRHPMNRQDQVQEKDTDPATSSQQTAPDTQAFRADKLHLQSETVDTGGPVVVRPVIVRDIQRSQTHSQCQAMDRMGPISRATKSPHVTGQGEGLDVQGLSSTR

SEQ ID NO: 532 - protein, 39 aa, Homo sapiens
AGTRQLQALSIPIRSGHHSWTPGVKQRRKAGVPPRAFGR

SEQ ID NO: 533 - protein, 39 aa, Homo sapiens
AGTRQLQALSIPRRSGHHSWTPGVKQRRKAGVPPRAFGR

SEQ ID NO: 534 - protein, 39 aa, Homo sapiens
AGTRQLQALSIPRWSGHHSWTPGVKQKRKAGVPPRAIGR

SEQ ID NO: 535 - protein, 116 aa, Homo sapiens
IDLDTQGLITATPHPREGLMPPMGTQDPEVQADKLVTMNNQETAPGTQGRVTMKLPLGPTALDTRRWARDNQRGPGQAGTGDPVLARTVTVRDTQKTLRGGLGLLPETIMDLLRSS

SEQ ID NO: 536 - protein, 116 aa, Homo sapiens
WYSSWLKHIMSLPEKRIYRYQDTSTESTVIMINMKIINRKKTKKTEKDPQVWKEETIEKGIREDPRAQEKQGGKGMNLVLKKKKEKDIHLLIEKKNMEKTIITQVKKRKTRLKILD

SEQ ID NO: 537 - protein, 32 aa, Homo sapiens
ALSIPRRSGHHSWTPGVKQRRKAGILPRAISR

SEQ ID NO: 538 - protein, 31 aa, Homo sapiens
ARTVTVRDIQKTLRGGLGLLPETIMDLLRSS

SEQ ID NO: 539 - protein, 26 aa, Homo sapiens
DSRATKSPHVAGQGNGLDVQGLPSTR

SEQ ID NO: 540 - protein, 195 aa, Homo sapiens
IGLDTQGTITATPHPREGLMPPMGSQDPEVQAGKQEMRNNQETAPGTQGHVTMNLPLGPAALDTHRWARENQRGPRQAGARDPVLVRTGTVRDTQKTLRGGLSRLPETIMDLLGSSQDMAPGTPGPIKKIEPVMGTLQRAPDNQALVMQRLPLVDRLHHPRNRQGQVQEKDMDPATSSQQTAPQTQALGADKIHL

SEQ ID NO: 541 - protein, 193 aa, Homo sapiens
IGLDTQGPITATPHPREGLMPPMGSQDPEVQAEKHVMRNSQETAPGTQGRVTMKLPLRLTALDTHSPARVNQRGPGEAGARDPVLARTVTVRHTQRTLRGDLSLLPETIMDLLGSSQEMAPDTPDPLTAIQPVMYSLHLYSQTLVPLRNMVTLVVFHKILRITQEYSHVAVLTVLVLIIINLRALKGKKVNQV

SEQ ID NO: 542 - protein, 84 aa, Homo sapiens
IALDTQGPITATPHPREGLMPPVGSQDPEVQAEQHVMRNNQETAPGTQCHVTMKLPLMPTSLDTHRQSRDNQRGPGEAGARDPV

SEQ ID NO: 543 - protein, 84 aa, Homo sapiens
IALDTQGPITATPHPREGLMPPVGSQDPEVQAEQHVMRNNQETAPGTQGRVTMKLPLMPTSLDTHRQSRDNQRGPGEAGARDPV

SEQ ID NO: 544 - protein, 174 aa, Homo sapiens
ARTVTVRDIQKTLRGGLGLLPETIVDLFRSSQGTAPDTPGPITKTEPVTGTLQTAPDNQALVTQRLPLVDRLHHPMNRQDQVQERDTDPATSSQQTAPDTQAFRVDKLHLQSETVDTGGPVVVRPVIVRDIQKSQTHSQCQAMDRLGPISRATKSPHVTGQGEGLDVQGLSSTR

SEQ ID NO: 545 - protein, 173 aa, Homo sapiens
TGQDMKIQARYHCRSPGQESVGDPELARTGTVRDTQKTLRGTLGRLPETIMDLRGSSQEMAPDTPGPMMKTEPVMGTLQTAPDNQALVTQRLPLVDRLHHPMNRQDQVQEKDMDPATSSQQTAPDTQPLGAGKLHLQSAIVDTGGLAVVRPVTVRDIQKTQTHNQCQATERLG

SEQ ID NO: 546 - protein, 63 aa, Homo sapiens
ALMNSLSLPMDGLGPVLEEDKDPATSRHETAPGTQRPKRVRTPFVDTRGQGEEEDRDPTTSNR

SEQ ID NO: 547 - protein, 63 aa, Homo sapiens
ALMNSLSLPMGGPGPALDEDKDPTTSRHETAPGTQRPKRVRTPFVDTRGQAEEEGRDPTTSNR

SEQ ID NO: 548 - protein, 63 aa, Homo sapiens
ALMNSLSLPMGGPGPALDEDKDPTTSRHETAPGTQRPKRVRTPFVHTRGQGEEEGRDPTMSNR

SEQ ID NO: 549 - protein, 63 aa, Homo sapiens
ALMNSLSPHTDRLHPALEEDKDPAMSRHETALGTQHPKTVRTPFVDTRGQAEEEGRDPTTSNQ

SEQ ID NO: 550 - protein, 63 aa, Homo sapiens
ALMNSLSPPMDAQGPALEEDKDPATSRHETAPGTQRPKRVRTPFVDTQGQAEEEGRDPTMSNR

SEQ ID NO: 551 - protein, 63 aa, Homo sapiens
ALMNSLSPPMDGPGPALEEDKDPTTSRHETAPGTQRPKRVRTPFMDTRGQAVEEGRDPTTSNW

SEQ ID NO: 552 - protein, 63 aa, Homo sapiens
ALMNSLSPPMDGRGPALEEDKDPAMSRHKTAPGTQHPKTVRTPFVDTRGQAEEEGRGTTTSIR

SEQ ID NO: 553 - protein, 63 aa, Homo sapiens
ALMNSLSPPMDGRGPALEEDKDPAMSRHKTAPGTQHPNTVRTPFVDTRGQAEEEGRGTTTSIR

SEQ ID NO: 554 - protein, 63 aa, Homo sapiens
ALMNSLSPPMDSLRPALEEDKDPIMIRHKTAPGTQHPKRVRTPFVDTRGQAEEEDRGPTKSNR

SEQ ID NO: 555 - protein, 63 aa, Homo sapiens
ALMNSLTLPMDGPGPALEEDKDRTTSRHETAPGIQRPKRVRTPFVDTRGQAEEEGRDPTTSNR

SEQ ID NO: 556 - protein, 63 aa, Homo sapiens
SETVETEGPVVARPVTARDTQKSQTHSQCQPTDRLGPISRATKSPHVASQGKGLDVQGLSSTR

SEQ ID NO: 557 - protein, 302 aa, Homo sapiens
RLRDPFRTARLGAVHLRTVCWGSAAPLARGPERGPPGGPAPGAPGPAELQGGGPTAALHPVWARWEATAPRTLRPASCESALRGWPLQVCAQLHGGHGGHPHAALGGGRDPGPPGWRPDEGAPAEAARICVRLVRRPRPQVLATEYPAAKRSPSQCGVAPIPGSCLCAVETAGTRDPRIRAASRGSLSSIPGQGSGCLLTPGGPPSVCTLPQIRGCRLQGGGAALVHRAERVDTRQLCHLVGGSLRGERRLPQECACCCGPREADALRALPEAWRHGGLLPVLLPQQLPLHVCPGQLLHLPG

SEQ ID NO: 558 - protein, 49 aa, Homo sapiens
GLPWSSRPTPGGGSWGAPGGGGGPPRARGAGLPPAAQVSSALRQTATLL

SEQ ID NO: 559 - protein, 48 aa, Homo sapiens
RPPQTPKGGGLTCPATSHYHLPTCSPGASTSPLSTTCPNSSIYPSSTP

SEQ ID NO: 560 - protein, 44 aa, Homo sapiens
LNFSGGPRHPKHPGAGHVSPPPPGGLGDGPQDGQQAPAGGSSKQ

SEQ ID NO: 561 - protein, 38 aa, Homo sapiens
PTTSPQWETRTSQLPPDVPVVPALWLPGRLHHGGPPLL

SEQ ID NO: 562 - protein, 108 aa, Homo sapiens
IPMGLLGQRSISGSAPLTCSTSWPPSTGCSLRGPPVMRKRMRCSSGQPDVPPAWSCPWPCVFVTLRRRPKKLWVSTDQPSTGEACSVSATSTRGRWSSSTLALSSARC

SEQ ID NO: 563 - protein, 30 aa, Homo sapiens
GVLGMEVLALERSHSPRRLPWLMAASPPKA

SEQ ID NO: 564 - protein, 25 aa, Homo sapiens
DDPPSSSSPSRCGSYPPKDPCPETG

SEQ ID NO: 565 - protein, 98 aa, Homo sapiens
WTPRCMAMPPASSTTPVSPTASLGSSTWRARNTLLSSPCAASCVVRSSPTTTSSPSRMPATSCPATVAPSAAVGSLTEAVAAHHDPSHLLLPSLPSCP

SEQ ID NO: 566 - protein, 173 aa, Homo sapiens
RGLNPMPSTCSLVPSALTPWVLCLISRTARDGSSPLATSAPVCTGAQWMLGGAAGIGAEFWSIGHGGRGKSQLTWRLQRRTRPLCTAPPLPQSPQVVRTPHWTQMFLSLELLSATRPFRTWTLHCGQIQAAPLLQPPVLFRGLESKCPTTRHPGGPWGVSPLAPCPPLEVHLH

SEQ ID NO: 567 - protein, 71 aa, Homo sapiens
VPAPPVSSRHPGDLWMKTPPNPQRWRSHLSCDLPLPPPHLFPRSQHQSPLHHVPQLLHLPQFHSLRRDGPS

SEQ ID NO: 568 - protein, 164 aa, Homo sapiens
ALEGRWRRWPGLSSRSPTEALSGLKMSRWKLRESGPQVPSPLCKVPASNMSAVMLLWPWVRPGPWCLKMSLASVPSLSGIGRTSPQRIHHRRPRLRVSRHGPGGERWRQQALGENQSPQVLEGPWPTHPGAHCPPITARRCAWLDVDTVGAAYVCRTVGPVSTA

SEQ ID NO: 569 - protein, 67 aa, Homo sapiens
LLQPLHLLHPSHPLRHLLHPHSALHHHPQCPHHLYHPLHRLLPKRSRRNPLLLWSQLRAPGRGAGLP

SEQ ID NO: 570 - protein, 163 aa, Homo sapiens
VCSPLCQGAPRWCACCVPAKDSTSWCSVKSAVTHSTHSAWRRPSGPCPSITTPGAAVAANSATSVDAKVVDPSTSWSASAAAMHTTRPVWGPAIQPGPRANGATGSVQPVCAVRAVGQLQARTGTSSGLEITASAPGAPSYMRKETTARSVHAAMKTTTMRAR

SEQ ID NO: 571 - protein, 156 aa, Homo sapiens
RRCCPGIPMNLLRPPLVLQAHAGGRELGGPGRRWWPTQGPRSRTPSCSASQLGAASNSDPPMISSRIRMTRSPGAPLLLGVGPPEKMSCHCQNLRSRAGPANLPCSLCCSSRPEGAWTRMLWPLAPLLLFPMAGLESRSLPMVCTASVWILRRIVI

SEQ ID NO: 572 - protein, 56 aa, Homo sapiens
WQTRRGRRLRTSGERDSLSWTSCGSSTTAEGRLLKKSLRWVGRSWIFTVSTPESLL

SEQ ID NO: 573 - protein, 54 aa, Homo sapiens
PSRRFWSAGANSSSAAIGWAAKCSVGPKCNATLRGSTNCAHFELTNIARSTDLK

SEQ ID NO: 574 - protein, 51 aa, Homo sapiens
FAKRRRKQRKQQVYMFMNVKLKSWRTRPADEEPQTPAMGIQRKMKCMWEVF

SEQ ID NO: 575 - protein, 37 aa, Homo sapiens
LQHKCLFLYKVFILWHKLFQEFHKILHLIPTSNKMLQ

SEQ ID NO: 576 - protein, 116 aa, Homo sapiens
KSTRKFIILGRMMMRYHQAIQSHSFLLVQFHLPTITSNTVCRIICVKVMGCPWTLIRQMIIINWCFHCYLDSQMKWTLLLTYALSYQMKASTSCNLKKILKSSLYYLLMPGCLTTL

SEQ ID NO: 577 - protein, 29 aa, Homo sapiens
KNPCGGWEGAGSSRSLHQSHYFRRIREGF

SEQ ID NO: 578 - protein, 95 aa, Homo sapiens
LNSFCFRNVVLQHQVVSLFSQLHRFLPLIMQELLALRWSIRWPVTKPQVLECRGKLQLSSYWLGSKMFSWSQVQCHPQGEYKLCPFRTYKYCQVH

SEQ ID NO: 579 - protein, 91 aa, Homo sapiens
YRATTCYSCEFSDIASPSICNSTAVSITHSGTRTDPFRHSCYSNSTSCPTESYVWQSTEHTSMYFYSFTGSTVNHHITPTCANFISTDISW

SEQ ID NO: 580 - protein, 76 aa, Homo sapiens
DPFPLYLEKNGKRRLIETSLSFGKTSLMIMKFVTSFLTETSLMKVHQENGFGSLYFIHLESWALTILKDSGYFRLQ

SEQ ID NO: 581 - protein, 377 aa, Homo sapiens
YTLGLDLINVKNVGKPSTLLIPVECMKELILEKNHMNVNDVANHSVGPFLFDCMKELILERNLMSVNSVIKPSVFQVPFENTKQLTLERNPMNVNNVVKPSVFQVPFKDMKGLTMQRNPMNVNSVGKPSGVQVIFEFMKGHTLERNPMNVNSVEKFSFVPVPFDCMKEHTLERNPMNVNYAVKPSVFQVPFENMKKFTLEISLLSVSNVVRPSFVPVKFDCMKGLTLERNRINVNNVEKPSFLPVNFECMRELTRERNPIDVNNVGKPSDFQVLFEFMKGLTLERNLMNANNVEKPSFLPVTFDCMKGLIWERKSKNISNILKPSVVPAPSEYTKEFILDRSCVNTNIVLKPLIVPVSFEHERIPTGEKQYECKHCD

SEQ ID NO: 582 - protein, 159 aa, Homo sapiens
SPMNVNSVGKPLYITSHFKDMKGLMLDRNPMNVSNVEKPLYITSLFKNMLILERNPMNVNSVGKPLYVTNLFKDTKGLTLERNPMNVSNVVRLSVVPHTFELMKELTLEKNPTNVKNVVKPSVFSVLFEGIKGLIVERNPMNVKNVEKPSFILQAFEHM

SEQ ID NO: 583 - protein, 40 aa, Homo sapiens [sequence omitted]

SEQ ID NO: 584 - protein, 120 aa, Homo sapiens
QALSARRLCAVPPLDGRGAIPVRCVQPSLSPADGVSSPTSALELAKMLMNARLSQGYAKEETVSIQWALLNADALLVTNRVKLLRNVKTLMSAASFLGYVKLVNVPTPWEAIFVFVHVDM

SEQ ID NO: 585 - protein, 119 aa, Homo sapiens
TLMNAPSPRNHATTSARTLRGVISVHVRGGMSCKRMERHAKTLMNVKQSSITASSSVSTPWGGLPVNVHLVSHSITLLVSTTTNVGLNLRFVEQRESVKTLQAVSAVNAKEGSLLMPPD

SEQ ID NO: 586 - protein, 27 aa, Homo sapiens
HGGGLPLWLPPWVLQSGTRPLCLRNGI

SEQ ID NO: 587 - protein, 100 aa, Homo sapiens
SGMKMNASTPFLESSAWMPAAVLSGRLGAPSVRSAPNLAPRNTRRCAPAGLALLTEGMFLLGGHFTKTSMNAKHFLGCALMGSAEIQSEASNAVAIVALL

SEQ ID NO: 588 - protein, 97 aa, Homo sapiens
MSARPPRTPAITAALTRRGATSVAAPLGITEWDKATVSQEWDLTRGSTCHWIQRSMRKMLCPQKHATSAKSTAILRKTAGRREVFMNLIPLLLNRSA

SEQ ID NO: 589 - protein, 86 aa, Homo sapiens
KTLTNARSYQVSARVETASTLLGASSVSAHKATTSARIPASVKILMSVLHILVCVGLGPAITPWEITPAFAHLSTCRSMEATTAWT

SEQ ID NO: 590 - protein, 190 aa, Homo sapiens [sequence omitted]

SEQ ID NO: 591 - protein, 15 aa, Homo sapiens
MPDPRNLHEWALHQQ

SEQ ID NO: 592 - protein, 67 aa, Homo sapiens
IQLAQEGLPGLKVLRVKMLMSVRCSLAFVQMDAVSTVRDLFIASALKALRWMGLAVYVWIFAWSSVT

SEQ ID NO: 593 - protein, 57 aa, Homo sapiens
KEIRTKSQSRSPWRRPLQNRTKVRDASIVLETSTVIPLKPQRTKIFLWRSTLWRGSL

SEQ ID NO: 594 - protein, 55 aa, Homo sapiens
PTPQDQKTRMMMTMPIAMCLNLNFQRPPSYRVITSKYLWLRGHETGYCFRMSLRN

SEQ ID NO: 595 - protein, 48 aa, Homo sapiens
TFSEKNQMLKLTQTCPNPALQQRVLARALSPPSPQLSRPCSSTVISSP

SEQ ID NO: 596 - protein, 44 aa, Homo sapiens
QHQVTSRCPHRQEPKAEPQLESREDCCQKRQACLRRPSPRRTRC

SEQ ID NO: 597 - protein, 28 aa, Homo sapiens
RTMGAAGVGSRWQTWPAKQEGSDPGHSA

SEQ ID NO: 598 - protein, 92 aa, Homo sapiens
LVWTGLRERSGGCHKHSRWPWVFFGKKSRDAVQTEYTRDSGGFCRLWKTPKWLQCYIQNTAWNTKKCCSHSRSAGLGQACQRQTEPSQHQWC

SEQ ID NO: 599 - protein, 16 aa, Homo sapiens
DSERNTISSRKWLCYL

SEQ ID NO: 600 - protein, 79 aa, Homo sapiens
KPHHPLFSTWASPRPLLPSTVAAPAARAPKPATQNRVSKQTRTAFHQALYFCLQMRHSGPHQFPTPGVTSLTQPLRALL

SEQ ID NO: 601 - protein, 39 aa, Homo sapiens
VGRRQAAWHLTCSAAGDSRGRPCGPVTVLYPCASLRGAG

SEQ ID NO: 602 - protein, 109 aa, Homo sapiens
WRAASRRPVSDGTSTLSPRHHWRVTSPGSVCGALACPSSTFPRGPGEAGMSWEEAGGLAPHLLCCRGQQRKTMWTCHCLVPLCLAQGSRLKGPQVDLETLRVENGGRPA

SEQ ID NO: 603 - protein, 29 aa, Homo sapiens
CQNRLGMSVRTHAAARPAAASSAQWTASS

SEQ ID NO: 604 - protein, 25 aa, Homo sapiens
LRLGACAGPWPAQALPSHGAPARPG

SEQ ID NO: 605 - protein, 63 aa, Homo sapiens
CGEYSGDRQLTRQILPFLANKAAATTGISSVQAPCQNRLGMSVRTHAAARPAAASSAQWTASS

SEQ ID NO: 606 - protein, 56 aa, Homo sapiens
PGSGMGRTRPRTRSSWRPGLQGMEPSRSGRLWWCLLERSRDTPAMCSMRVCPSPSP

SEQ ID NO: 607 - protein, 46 aa, Homo sapiens
GISSHPCPGPAAGSPASSPWATWTTRSSCGSTATPRARGWSRGRRG

SEQ ID NO: 608 - protein, 46 aa, Homo sapiens
GISSHPCPGPAAGSPASSPWATWTTRSSCGSTATPRARRWSRGRRG

SEQ ID NO: 609 - protein, 43 aa, Homo sapiens
GGAVESLPGWHVRGVAPQIPGEREGDAAAHGPPQDTYDPPPHL

SEQ ID NO: 610 - protein, 121 aa, Homo sapiens
PSEPGDPARLLQPERGRFSHHPDNVWLRRGAGRALPPRVPAGRLRRQGLHRPERGPALLDRGGHGSSDHQAQVGGGPCGGAAESLPGGPVRGRAPQIPGEREGDAAAHGPPQDTYDPPPHL

SEQ ID NO: 611 - protein, 18 aa, Homo sapiens
WPSWRPEPSSCYSRGPWP

SEQ ID NO: 612 - protein, 77 aa, Homo sapiens
PSGPGDPARLLQPERGRFSHHPDNVWLRRGVGRALPPRVPAGRLRRQGLHRPERGPALLDRGGHGGSDHQAQVGGGP

SEQ ID NO: 613 - protein, 11 aa, Homo sapiens
PTTPSLTMRPP

SEQ ID NO: 614 - protein, 65 aa, Homo sapiens
GHPEVLGPGLLPCGDHTDLAAGWGGPDPGHGARGDQACRGWNLPEVGGCGGAFWRGAEIHLPCAA

SEQ ID NO: 615 - protein, 441 aa, Homo sapiens
NLSVISAALFTISEFTVEKDLISVENVGNLSVKRATSFYTSEFTLEQDLMSVENVGNHLVQKDILGTISKFTLGTDFMSVESVGNLLVIKAPSFYISEFTLEKDLMGVENVGNLLVQSGTLGAISAFILERGLMSVENVGNLLVISAALFTISACTLEKDLTSVETVGNLLMKKDTLGIISEFTLQKDLLSVGNVGNVLVTRVTSFYTSMAILEKDLMYVGNVENYLRRSLTSLYTREFTMEKSHMLVKLVRNFLETSTNSLHIREFTLEKGLMNAMIVENHLPTALHSVFISEFTLEKSLMSAVNVENLSLKAPVSQNTKEFTLEKSLMSAVNVENLLLKAPVSLNTREFTLEKSLINVRNVGNYLTRSLTSLYTRVHTGEKPYECEDCQKVFSKKDHLIAHQRVHTGERPYECSDCGKSSTHSSAFCVHKRVHTGHTTL

SEQ ID NO: 616 - protein, 112 aa, Homo sapiens
QEVSPPCTPEFTLEKSHMSVRIVRKFLARRTTSLHTREFTLEKGHMNAVIVGSHLPTALHSVFIREFTLVTPPYECSECGKSFAETFSLIKHRRVHTGVRSCDCSKCGKKVT

SEQ ID NO: 617 - protein, 212 aa, Homo sapiens
VIIREFTLKKNMNVENVGNPLANMLASVIIREFTLKKNMNVENVGNPLANMLASVIIREFTLGKDLMNVENVGNRLANMLASVIIREFTLKKNIMNVENVGNPLANMLASVIIREFTLGKDLMNVENVGNRLANMLASVIIREFTLTKNIMNVENVGNPLVKRAASFNISDFTLEKNLMGVKNVGNLLVQKDILGAINEFTPEKDLSSVENV

SEQ ID NO: 618 - protein, 176 aa, Homo sapiens
RWRTWHLYPPWVVGVEWKMRRHLLSRVFIYKERLRSGLLWQVCLPRRPTPVRCVARSWETFCMWQIIREHITSRNCTGVRPGGINCMTVETFISTRMSTLERNPTEGVLRRRCLQRGVSCMCQGSHLSSVRVGRTFCPGQDYSSRRPVTLGRSQTAKLSVCLPFSVGELTTAVENP

SEQ ID NO: 619 - protein, 40 aa, Homo sapiens
ASPSSRHEEKNRRVSGIFSEAPGIQSRPREGQRNRPRFQQ

SEQ ID NO: 620 - protein, 24 aa, Homo sapiens
CKEEFLHHRQILSSCTDTWLRLHL

SEQ ID NO: 621 - protein, 20 aa, Homo sapiens
PCQALKNTLNRFQDQENLTM

SEQ ID NO: 622 - protein, 76 aa, Homo sapiens
SYHMKDLLKEKKISPCLQSNLGNRRTVHRKMRTKQKYLEPNASNMKYLKARKKKKMPQSPRMQQRFHQSKKKNKRL

SEQ ID NO: 623 - protein, 66 aa, Homo sapiens
RKGPSPIPTCLASWLTSTRPLISIASTDTPSTIFIMNRHPNTLPGTCTGNRKTVLFLPTDTKKSSM

SEQ ID NO: 624 - protein, 37 aa, Homo sapiens
IYSKPSHIGEWGEWGSCVADQSLKHKAGVCSWESEWD

SEQ ID NO: 625 - protein, 29 aa, Homo sapiens
RVGTLCAFIPGTQRPATSSSDMSLLENFG

SEQ ID NO: 626 - protein, 24 aa, Homo sapiens
TNTSKTYDASDRTPVSTRLHFIAP

SEQ ID NO: 627 - protein, 80 aa, Homo sapiens
MRTPQETKKNKRKMKNMLVNKMRRMRRRRRWTRRVTILISLMIVAEKMNIHILTVSRTPVVLWTCPFTNSPPHSIQKQQK

SEQ ID NO: 628 - protein, 14 aa, Homo sapiens
KCFRAGVDQRNCLL

SEQ ID NO: 629 - protein, 68 aa, Homo sapiens
NPSFNETSFHCSLKSWHSMCFHSWNPKTCYKQLRHVATGEFWLKTTFSGERNAKKRGLMNHCTSREEK

SEQ ID NO: 630 - protein, 67 aa, Homo sapiens
ETTSSLVDLQIGHSKCGMQRLENVYTPYMGILPLCVVCIFMKKELLAVLEMPLLGFGILRQASVYMF

SEQ ID NO: 631 - protein, 36 aa, Homo sapiens
LLQEKSWKYLEKAVGQSPLQGAFGLPVQHPVTEPLQ

SEQ ID NO: 632 - protein, 34 aa, Homo sapiens
PPKQHPWAQLSNLWWSMMISALIPTPSPMTWPSN

SEQ ID NO: 633 - protein, 31 aa, Homo sapiens
TEGRTTNVVDQIGATACTNIVTTSTGVPGTY

SEQ ID NO: 634 - protein, 100 aa, Homo sapiens
KRRLLLQRRQKHQKRRPLHLFPQLLLPHPLYQLLPLHLRHPLCHLCLQYQLFHSNHLCLLLSQHLVRFLLPVLQLCPLLLTQRHLLCPLRQILSPLYRFL

SEQ ID NO: 635 - protein, 97 aa, Homo sapiens
RKRRNRGHVTYSQTFLSLQSSLVEICLPQTLQNQRQSHHLSNHIKRDQKFVVLVMEKEDKQKATGGNAVWTSLTLLGLLEKEPMAKYIKPRTKTQEN

SEQ ID NO: 636 - protein, 23 aa, Homo sapiens
TGECNTSKHRGKKFFRYRESKVG

SEQ ID NO: 637 - protein, 74 aa, Homo sapiens
KPKSQQAVWRKTTVTRTVGHRGPEELPQCHRRRQQHVLLTFFHQRRGPLSPPDLHRRHLHPLWLKAIFPAPPRS

SEQ ID NO: 638 - protein, 65 aa, Homo sapiens
KPKSQQAVWRKTTVTRTVGHRGPEELPQCHRRRQQRRGPLSPPDLHRRHLHPLWLKAIFPAPPRS

SEQ ID NO: 639 - protein, 65 aa, Homo sapiens
SGSCFQYFNFAPFYSLKDICCVLSGKFSAPCTGFCEDSSICNSCYSTPENFNVASFAPPTLITWR

SEQ ID NO: 640 - protein, 149 aa, Homo sapiens
PALQQSHQRHQHGLRPAPREPLASGAVPVWPTPGRSTGRLFSRRGPVRLPGAPRRPGPIVRSAARGVRLPGKPPLVSPGPGQPWSSSRGRSGSGGALGETGGATRTTLCDRLRGLRRGRPVPGRANSFASPDGGHRWARSRSPRRTLGD

SEQ ID NO: 641 - protein, 122 aa, Homo sapiens
RWAPVGEKPEPAENPRGLSRRVWRSHQVLSFRRPPGPGCGSQRPGRTTSAPVSSATKASMGRAMPARPWTASTTPSALFAALVGELCVARLSTVSMALCTVRKIICFQGFRRQLRNAVSVVT

SEQ ID NO: 642 - protein, 202 aa, Homo sapiens [sequence omitted]

SEQ ID NO: 643 - protein, 87 aa, Homo sapiens
RWAPVGEKPEPAENPRGLSRRVWRSHQVLSFRRPPGPGCGSQRPGRTTSESCSHGPLCTEPSAKPDPFLHPWKSAVERNHSITEQLV

SEQ ID NO: 644 - protein, 82 aa, Homo sapiens
AVGSGGATRSFRSGGRPGPDAGARGQGGLLRHLYQVQQRHLWAEQCLPGPGQPLPHPVLCLLLLWANFALQGFLQCQWLCVL

SEQ ID NO: 645 - protein, 50 aa, Homo sapiens
GRPRNAKEDVHSPGQPRYWGTVDVQSRHFPQTETHQQHFRQTWIYFGLPK

SEQ ID NO: 646 - protein, 270 aa, Homo sapiens
GHRTSKIYVPARVRATPRPRAKRSMAPRPATRPRSPPPRRRSPAVTRAAPRSRLTFSLLSGPGTAGGWTKRRPTHAIAPPPSRPALAAWARRSAGARFARAQRRPRWKRRARSRARRPSRRSRCRRTRPPRTWPRAPCLASASPRAWRANSSSTGTRSSCTPASLPWGAPSPAWRPLAWVPSWPRFLGPPPVSRAWIPRPWPLPLRRRDCPGRPRPPCPSTSSSTSWPLRAWPCPLSEACSLTPTRTWPQRRPPPLRQPPARCTATPSSI

SEQ ID NO: 647 - protein, 37 aa, Homo sapiens
DNPVKNRQQPFCKRFPGHWKWPKRKKKTAHPAVHEGV

SEQ ID NO: 648 - protein, 37 aa, Homo sapiens
GCLMKDTKRRMGPLMSPPVNKQLSTASPRLLLQPPPL

SEQ ID NO: 649 - protein, 34 aa, Homo sapiens
NSPTTFQTNMDLLWPSQVITLRGRGIIVLVLRLY

SEQ ID NO: 650 - protein, 23 aa, Homo sapiens
FWYSDYIELHAQIPAPVPHCKSQ

SEQ ID NO: 651 - protein, 13 aa, Homo sapiens
KSQIHFIDGHYSC

SEQ ID NO: 652 - protein, 63 aa, Homo sapiens
GRPRNAKEDVHSPGQPRYWGTVDVQSRHFPQTETHQQHFRQTWIYYIELHAQIPAPVPHCKSQ

SEQ ID NO: 653 - protein, 47 aa, Homo sapiens
RASTSGKRWRRAACPSSTTDPRGPPKVPARCRRRRARMSAGAARRRL

SEQ ID NO: 654 - protein, 111 aa, Homo sapiens
PGADGRQAGGAPQALGLQEPLRPGGPRRVNPGLGEALQRHGRGEPAQVEFRFSESQTPRGQVRVARGGEGQLARVLLQTPAAPQRCLQGAGAGEPGCQREPPGGAFNWGSG

SEQ ID NO: 655 - protein, 28 aa, Homo sapiens
PGTWRSTAETWKRRASASGISIFRITNP

SEQ ID NO: 656 - protein, 25 aa, Homo sapiens
LGLRLTLRTRIWWTQRLIRRTARRG

SEQ ID NO: 657 - protein, 100 aa, Homo sapiens
CRAAARLAARPAPRPSRARRAPASSSQWAVYTGCCGRATTPSALAPARQCTWRQCWSTSPLRSWSWRAMRPATTRRRESSPATCSWPSATTRSSTSCWAA

SEQ ID NO: 658 - protein, 167 aa, Homo sapiens
DPGAGGQCGPRQQEDANHPPPPAAGHPQRRGAQQAAGRRDDRPGRRPAQHPGRAAAQEDQRHRGAEGALGRQEGHPGLPGVLRGPAPRPAARPPHATTKALLRATTALMERAEPLQTAGQAGRGSLPLPSPRPPSPPGLESPPAPAPVPHRLPRRPRALPCPPSALR

SEQ ID NO: 659 - protein, 57 aa, Homo sapiens
SIVGFILERNLTSVMSVARPSVRCHPLYTIIGFIVERSLNSVMSVARPSITIQPCKS

SEQ ID NO: 660 - protein, 44 aa, Homo sapiens
STQGHCTDKQVITLENFVSMKLRKTFMASSFSGKKMKQMAMQHP

SEQ ID NO: 661 - protein, 244 aa, Homo sapiens
KRNNVNVMYVARSLIRSDTLPAIVDVTLVRNLTSVMSVARPLVIIHPSSFTKRFILERNLMNVKNVTKFSVANHTLKDIRGFILERNHTNVRFVMRLSHIIHIWQNILYFTLERNLTHVMNVAKFLIDYQPLHAIIDFILERNLTNVKSVTKFSVANHTLKDIGGFIVERNLTNVKNVAKFSVANQTWKDTGGFILERNHTNVRFVTRLSRGIHTWHNIREFILERNLTSVMSVARPSVRHHRL

SEQ ID NO: 662 - protein, 54 aa, Homo sapiens
SPSLPATESPDPSRAARSPLSTPREPCLSPRTRACQASPQCLSPTPWFSRPPSP

SEQ ID NO: 663 - protein, 122 aa, Homo sapiens
RAFAFGGFLASSTTLRPSSTSFSTSQQPPCLFPAPVGSGPHSWGWGGICRGSRGSKWGAIFRLGRPVPPTFPPTFSPPYPHSFKFCAAGCHPGSPLGDTPPALCPECPPTWTTYLQCHHGNY

SEQ ID NO: 664 - protein, 110 aa, Homo sapiens
PHPMVLPTPQSLSCSLGGGQGNGAGGEEGDLGALMVRPGQPGAESLAAGGSLADWPSNGGHVVASMDKWKGPQEEPTIGSIMGSWLKGVLSPRIHPLPGPILRTLRCPRE

SEQ ID NO: 665 - protein, 109 aa, Homo sapiens
KGEALKPLDGAVLGPLLLSPNPFLSRSHPNQFSLLCCPCWDSPPLALPTLMEALTFWGQMHTFLLPQPSPQGALPSPGTPSSPPCLGPPVAASAVCQVPLPHQLPPKPQ

SEQ ID NO: 666 - protein, 108 aa, Homo sapiens
HPLPCPRAIISPPTLVLPLSHQCLQPLCTCPWSWGPWEGPPRWRGLGHPPSLLAAYSLQRPRHSIPHYPLPALYRAEGPVPRHPQLPTPHHFVPLSVVPADPLLYFDC

SEQ ID NO: 667 - protein, 88 aa, Homo sapiens
QALGGFSPQGLLTQSLLGAVAAPVSSQGAMPPLQPHLLHLLSASMLPHTTGELPSDPAWCPLTWALLRPLMPPPHHLQTLLSSTVVMP

SEQ ID NO: 668 - protein, 86 aa, Homo sapiens
PQESLKGLRFWWLPCFLHHPQTFFHLLQHLPATSLPLSCPCWLWAPQLGMGRDLQREPGVQVGSHFQAWETCPPYFSPHFQPPLPS

SEQ ID NO: 669 - protein, 80 aa, Homo sapiens
MGAMRAVEQTELGALWPHLSPSAGSAVCERVLCSTSVQVAQSCLPWSKPGATSSAMGPASAVWSVHLMSPRFSTLTLWPR

SEQ ID NO: 670 - protein, 80 aa, Homo sapiens
PSCATTGGKLLLWQLCTAAWRPPAHTLLLERERAPKCSTLCPQGPPLPALPVEFLLQLHLMGVLAPFPQNHPQFPRPFPL

SEQ ID NO: 671 - protein, 60 aa, Homo sapiens
YTKTPALLSCQCRPPAQFRDRIIVFGIQTNSLSVYSSSTLLHSLKQPYIIKDRHVQQSMV

SEQ ID NO: 672 - protein, 53 aa, Homo sapiens
SLGSAAPLSSQTKNHCLTSQLEDSSRSRREDLLLPCDHKADSVGSSYLGKPRR

SEQ ID NO: 673 - protein, 50 aa, Homo sapiens
SRERHQCPQVQHWLGPPVSWMTSGTHSDGRNVPSKGKCHVTLILLKKMFI

SEQ ID NO: 674 - protein, 126 aa, Homo sapiens
RRYIEFQRKVKLKRKTQQLNEEGMLLASEIKHLPRRLLIGQERETQTSKLKIKRKGNEEAPSHHPLLPMSGEQKGQMTDMIHQLLKRKYELKTAINFLQRNAGSCLSKRWLNGRLRNNSNRCRTWE

SEQ ID NO: 675 - protein, 38 aa, Homo sapiens
AVKKQVLRRNPHNLKASFLVQNLMKILYGLLQVKDHMI

SEQ ID NO: 676 - protein, 38 aa, Homo sapiens
QIISWICRPPLLPNQKPLSYLPTGRQLEIQKGRFITTM

SEQ ID NO: 677 - protein, 35 aa, Homo sapiens
RLWNTCPFLLKICWRKAKYFQLFNAGLRLRLLSLR

SEQ ID NO: 678 - protein, 28 aa, Homo sapiens
MSKQIFPQKKKIPILGRMKKFQIVLRLV

SEQ ID NO: 679 - protein, 28 aa, Homo sapiens
NPKMDCERTTEGWVFYHQTGSFRLRVNV

SEQ ID NO: 680 - protein, 19 aa, Homo sapiens
RVILKVMVSFRTERKLEWR

SEQ ID NO: 681 - protein, 17 aa, Homo sapiens
KKMISKIEGLLKKGGRK

SEQ ID NO: 682 - protein, 60 aa, Homo sapiens
VLQPLLFPQLISCPPHFLPVLLPPLLFLLMCPPPTPLPRLHRLLLAHLPLSCPPPCTPQP

SEQ ID NO: 683 - protein, 47 aa, Homo sapiens
PPVGPAKPTAHSAQLQPLLPSYPPRLGCLRTLAQGHRHHLSPHNSPT

SEQ ID NO: 684 - protein, 125 aa, Homo sapiens
HYQPQPHQGQAPRCQNRPIRNCQEQRPPRRQAHVQPQQAPQAQPPHSQDNPRGPQPQRPLKQERLLNTQRPKPHTPHTPRLRRGVPSLPQVLSLQHLSMPPLPIQPHHTLRPHFPLTFHLSPPPW

SEQ ID NO: 685 - protein, 41 aa, Homo sapiens
TKRASVCARPSARAYWRVTSSSWPSSPLSSTASPATASTGG

SEQ ID NO: 686 - protein, 247 aa, Homo sapiens
LQDLLLLKGEVGLSAGHPLPIHLHPLRGGPRHHLRRPALRIRRQLRVHPGHGRLWCQRLTAHLQDPDRERHLWELRGHMLTGHQDLPGGPVRGAGGQKLHGHRGGAPRAARGDAGCAEPCRGHQHPREVQPDAHLEQAHDHPHQDRPCLPGSPLRLVWQLQREHEGRLRDAQQVRGIQRAGVGELVEGEPAVRGRELRDRPLQSQCLPALLGRAQVQRHQQPDLCHLPQQGIPPALLRGLRARRMWV

SEQ ID NO: 687 - protein, 119 aa, Homo sapiens
PPVGPANPEAHLARPKPLHPYIHTLPPHTILKSPQLLPPASPPTTPVQAPEPLWPTPRRPPAAGYPHPSPHTPHLQGPLPSLPQVLSLQHPSRPPLPIQPHHTLTPHFPLTFHLSPPPW

SEQ ID NO: 688 - protein, 32 aa, Homo sapiens
LQHPSRPPLPIQPHHTLRPHFPLTFHLSPPPW

SEQ ID NO: 689 - protein, 32 aa, Homo sapiens
RQHPSRPPLPIQPHHTLRPHFPLTFHLSPPLW

SEQ ID NO: 690 - protein, 68 aa, Homo sapiens
REPPPPSGFSAPPDPHPALITPLPAPPRHPSFQPRSHPPSPQPPRENHLDQPRPSPHKPHQGCLPQPH

SEQ ID NO: 691 - protein, 65 aa, Homo sapiens
ARGHTPHCPLIPRLHQCLHLLFFLLLQLPLLPLGPLSPTLSPLLSPSLLYSPYPLLPCLPPHPAT

SEQ ID NO: 692 - protein, 53 aa, Homo sapiens
TRRTMGGCAAPGVTSTTRPSTATSSASLAFATTCSLSTAAPPTRTSTSSYAEA

SEQ ID NO: 693 - protein, 50 aa, Homo sapiens
GPPTHPQCRTPRPPHTGGPCPPAVPTRCAQPGLRPPRASWAPPTSQSLPR

SEQ ID NO: 694 - protein, 50 aa, Homo sapiens
GPPTHPQCRTPWPPHTGDPCPPAVPTRCAQPGLRPPRASWAPPTSQSLPR

SEQ ID NO: 695 - protein, 134 aa, Homo sapiens
HTDQWYSPITDHHGHYDHGHRLHHQPLLNSRDNTYPPSADHHRHHTCSHQQHSDSLLCPRDHPHTPSAEHHGHHTRAIPVPQQSPHGAHSLDFGHLRHLGHHPHHRAFHGDFPHPSSNHRYHPALDSSPVQPSP

SEQ ID NO: 696 - protein, 134 aa, Homo sapiens
HTDQWYSPITDHHGHYDHGHRLHHQPLLNSWDNSHPPSADHHRHHTCSHQQHSDSLLCPRDHPHTPSAEHHGHHTRAIPAPQQSPHGAHSLDFGHLGHLGHHPHHRAFHGDFPHPSSNHRYHPALDSSPFQPSP

SEQ ID NO: 697 - protein, 134 aa, Homo sapiens
HTDQWYSPITDHHGHYDHSHRLHHQPLLNSRDNSHPPSADHHRHHTCSHQQHSDSLLCPRDHPHTPSAEHHGHHTRAVPAPQQSPHGAHSLDFGHLGHLGHHPHHRAFHGDFPHPSSNHQYHPALDSSPVQPSP

SEQ ID NO: 698 - protein, 128 aa, Homo sapiens
PRAVSPSVPGQSGWTTATPCRGPLAGTLTPTPTSVRPEGPSVSSPWASSAVPRPSLVSPWGSWARSWNAAWTLAWSAGTVSRWGSSRCASTMKSVCSAATTATAPAPRPPALRPCPPPLRGRPGSSQS

SEQ ID NO: 699 - protein, 128 aa, Homo sapiens
PRAVSPSVPGQSGWTTATPCRGPLAGTLTPTPTSVRPEGQSVSSPWASSAVPRPSLVSPCGSWARSWNAAWTLAWSAGTVSRWGSSRCASTMKSVCSAATTATAPAPRPPALRPRPPQLRGRPGSSQS

SEQ ID NO: 700 - protein, 128 aa, Homo sapiens
PWAVSPSVPGQSGWTTATPCRGPLAGTLTPTPTSVRPEGPSVSSPWASSAVPRPSLVSPCGSWARSWNAAWTLAWSAGTVSRWGSSRCASTMKSVCSAATTATAPAPRPPALRPCPPPLRGRPGSSQS

SEQ ID NO: 701 - protein, 126 aa, Homo sapiens
EAQPPHPQLPALQPSPPPPWAPPGPAYHRPPHPRPPCPQPHPPPLQRLSTPPQCLPPRPPQPGPPALWPPPPPPQEQLTLPKCRLPQPRASQPPPPPAQGRHSRLQCGSAQPPHPQPPHPQPVAPR

SEQ ID NO: 702 - protein, 123 aa, Homo sapiens
GPPTHPQCRTPRPPHTGDPCPPAVPTRCAQPGLRPPQAPWAPPTSQSLPRGLPTPQQQPPVPPSTRLQPCPALTLAAGPPSHPLLQGRPPRATPGPPPGPRPRPHPARPAPRPCCPAAPHRPQ

SEQ ID NO: 703 - protein, 123 aa, Homo sapiens
GPPTHPQCRTPRPPHTGDPCPPAVPTRCAQPGLRPPQAPWAPPTSQSLPRGLPTPQQQPPVPPSTRLQPCPALTLAAGPPSHPLPQGRPPRATPRPPPGPRPRPHPARPAPRPCCPAAPHRPP

SEQ ID NO: 704 - protein, 121 aa, Homo sapiens
EAQPPHPQLPALHPSPLPPWAPPGPAYHRPPHPRPPCPQPHPPPLQRLPTPPQCLPPRPPQLGPPALWPPPPPPQEQLTLPKCQLPQPRASQPPPPPAQGRHSRLQCGSAQPPHPQPEAPR

SEQ ID NO: 705 - protein, 121 aa, Homo sapiens
EAQPPHPQLPALQPSPLPPWAPPGPAYHRPPHPRPPCPQPHPPLLQRLSTPPQCLPPRPPQPGPPALWPPPPPPQEQLTLPKCRLPQPRASQPPPPPAQGRHSRLQCGSAQPPHPQPEAPR

SEQ ID NO: 706 - protein, 121 aa, Homo sapiens
EAQPPHPQLPALQPSPPPPWAPPGPAYHRPPHPRPPCPQPHPPPLQRLPTPPQCLPPRPPQPGPPALWPPPLPPQEQLTLPKCRLPQPRASQSPPPPAQGRHARLQCGSAQPPHPQPVAPR

SEQ ID NO: 707 - protein, 452 aa, Homo sapiens
NPCVLLQLRPLPQHPGHQLYGHALLHSGDDLDPHRADHNSHYDCIHWIHGHPVLHPGNSSPSQSADQPGHHTHSHQFQSHFLLQSKDCNHPSSADKHSHQIHSYQRYTHPLLHPWDHRDPPRTDHHTRGHHVHNPPLLHSGDHPHLHSADHEGHHDKGHQFHVHPLLHSGDDLDPHRADHSSHYNCSHWPHGHPVLHPRDHLDPHRADHNSHYDCVHWIHGHPVLHPRDHLDPHRAEHYSHRDGAHRIHGHRLLHPGNCWHPTCEHHGHDTHSHQLQSHSLLQSRDCNCPSSTEKHSHHTHSYQLYSHPLLLPGHHLDPPITDHHTHGHHVHSHTLLHSRDCPHLHSAYRHGHHNRGHRLCGHPLLHPRNSSHYQSADYHNHGLHSHPLLQPRDGTHASSVDQHNHHTHNHHTHNQWLHGDPLLHPGDHPHRQSADHHHHNCGHWFYGNTLL

SEQ ID NO: 708 - protein, 244 aa, Homo sapiens
PRSSLGTCRSWMGPRSSARTRCPCRPATARTRRASATAPCWGRPLRSATHWWTALRTWPPAPRTCAAAPPARVPPLWNTHASAPTRGASRGTGGALSSAPGPAPSTCSTRSVAHPARTPAPTPSARSSARTTVWTAASAPQARCWMTSRTLAACPSGSAPAPTAAAPTARAPPSTPPAAPAPAPGGYGSARTCRALAPALCRAGPTSPPMMRNSTTCMVTAATFCPRNVPTAASPCWLSCGSAA

SEQ ID NO: 709 - protein, 37 aa, Homo sapiens
LPQPRASQPPPPPAQGRHARFQCGSAQPPHPQPEVPR

SEQ ID NO: 710 - protein, 242 aa, Homo sapiens
RLQPLPQYPSHQLHGHALLNSGDDLDPHKADHNSHYDCVHWIHGHPDLHPENSSPSQSADHHGHHTHSHQLQSHSLLQSRDCNRPSSTEKHSHHTHSYQRYTHPLFLPGHHLDPPITDHHTHGHHVHSHTLLHSRDCPHLHSAYRHGHHNWGHRLCGHPLLHPRNSSHYQSANYHNHGLHSHPLLQPRDGTHASSVDQHNHHTHNQRLHGDPLLHPGDHPHRHSADHHHHNCGHWFYGNTLL

SEQ ID NO: 711 - protein, 232 aa, Homo sapiens
VHWIHGHPVLHPRDHLDPHRAEHYSHRDGAHRIHGHRLLHPGNCWHPTCEHHGHDTHSHQLQSHSLLQSRDCNRPSSTEKHSHHTHSYQLYSHPLLLPGHHLDPPITDHHTHGHHVHSHTLLHSRDCPHLHSAYHHGHHNQGHRLCGHPLFHPRNSSHYQSADYHNHGLHSHPLLQPRDGTHASSVDQHNHHTHNQWLHGDPLLRPGDHPHPHSADHHHHNCGHWFYGNTLL

SEQ ID NO: 712 - protein, 232 aa, Homo sapiens
VHWIHGHPVLHPRDHLDPHRAEHYSHRDGAHRIHGHRLLHPGNCWHPTCEHHGHDTHSHQLQSHSLLQSRDCNRPSSTEKHSHHTHSYQLYSHPLLLPGHHLDPPITDHHTHGHHVHSHTLLHSRDCPHLHSAYHHGHHNRGHRLCGHPLLHPRNSSHYQSADYHNHGLHSHPLLQPRDGTHASSVDQHNHHTHNQRFHGDPLLHPGDHPHPHSADHHHHNCGHWFYGNTLL

SEQ ID NO: 713 - protein, 419 aa, Homo sapiens
NPCVLLQLRPLPQHPGHQLYGHALLHSRDDLDPHRADHSSHYDRNHWIHGHPVLHPGNSSPSQSADQHGHHTHSHQFQSHFLLQSKDCNHPSSADKHSHQIHSYQLYTHPLLHPWDHRDPPRTDHHTHGHHVHNPPLLHSGDHPHLHSADHEGHHDKGHQFHVHPLLHSGDDLDPHRADHSSHYNCSHWPHGHPVLHPRDHLDPHRAQHYSHRDGAHRIHGHRLLHPGNCWHPQSADQHGHHTHSHQLQSHSLLQSRDCNRPSSTEKHSHHTHSYQRYSHPLFLPGHRLDPPITDHHTHGHHVHSHTLLYSRDCPHLHSAYHHDHHNQGHRLCGHPLLHPRNSSHYQSADYHNHGLHSHPLLQPRDGTHASSVDQHNHHTHNQRLHGDPLLHPGDHPHRHSADHHHHNCGHWFYGNTLL

SEQ ID NO: 714 - protein, 28 aa, Homo sapiens
PQQPLRLHPLDPRPPRPPPREQLPLPKC

SEQ ID NO: 715 - protein, 28 aa, Homo sapiens
PRRPPRQGPPVPCPPPPPLRGRPGSSQS

SEQ ID NO: 716 - protein, 28 aa, Homo sapiens
PRRPPRQGPPVPRPPPPPLRGRPGSSQS

SEQ ID NO: 717 - protein, 83 aa, Homo sapiens
EAQPPHPQLPALQPSPPPPWAPPGPAYHRPPHPRPPCPQPHPPPLQRLSTPPQCLPPRPPQPGPPALWPPPPPPQEQLTLPKC

SEQ ID NO: 718 - protein, 14 aa, Homo sapiens
PPPPSRGPPTPPEC

SEQ ID NO: 719 - protein, 14 aa, Homo sapiens
PPPPSRGPPTPPQC

SEQ ID NO: 720 - protein, 74 aa, Homo sapiens
PARTKTRQAGSTCASTTTCVCFAVTTTATAPVPQPPAPRPRPPQLRGRPGSSQSRPQQPLRLRPLDPRPPRPPP

SEQ ID NO: 721 - protein, 72 aa, Homo sapiens
LPTPQQQPPVPPSTRLQPCPALTLAAGPPSHPLLQGRPPRATPGAPPGPQPQPHPARPAPRPCCPAAPHRPP

SEQ ID NO: 722 - protein, 67 aa, Homo sapiens
QQPPVPPSTRLQPFPALTLAAEPPSHPLLQGRPPRATPRPPPGPQPRPHPARPAPRPCCPAAPHRPP

SEQ ID NO: 723 - protein, 65 aa, Homo sapiens
VRPTSPAAFPSCLWTAAPAPRAPSSMTRAPVCPPRSAPATLTAPCWLLERWCTTRAPCVHVRVGS

SEQ ID NO: 724 - protein, 157 aa, Homo sapiens
PWAVSPSVPGQSGWTTATPCRGPLAGTLTPTPTSVRPEGPSVSSPWASSAVPRPSLVSPCGSWARSWNAAWTLAWSAGTVSRWGSSRCASTMKSVCSAATTATAPAPRPPALRPRPPPLQGRPGSSQSRPQQPLRPQPLDPRPSRPPPREQLPLPKC

SEQ ID NO: 725 - protein, 42 aa, Homo sapiens
KIHESSITFKKGTIQPKHKSKSNPKKSRRNYFNFKNNCQSRL

SEQ ID NO: 726 - protein, 41 aa, Homo sapiens
EETKATRLSTARQSVSCKNIHSASNLSESSSRRPSSLCVFS

SEQ ID NO: 727 - protein, 41 aa, Homo sapiens
TNPFSRTLPWFYMETQVINKQPKCQLKKIWFMFLQRRTKIV

SEQ ID NO: 728 - protein, 35 aa, Homo sapiens
AQIYLKLLAIKLVVQIPKKWPLLNLQMGGMLLRPS

SEQ ID NO: 729 - protein, 35 aa, Homo sapiens
SKNRRVPRPVRKNVRKISRTQLQLKNISKHLQRRQ

SEQ ID NO: 730 - protein, 33 aa, Homo sapiens
QRQKKLSINNYRFQMKFYFRFTSHGSPFTSANF

SEQ ID NO: 731 - protein, 29 aa, Homo sapiens
TQRTKERKIFLLQRILCHVFLAYQNQRSH

SEQ ID NO: 732 - protein, 23 aa, Homo sapiens
VRLHYLKQKNGLEKEYLMVNQKE

SEQ ID NO: 733 - protein, 20 aa, Homo sapiens
RRFVRFNFFGSCESSRSMSW

SEQ ID NO: 734 - protein, 18 aa, Homo sapiens
SEMKKHLKLYFLMILLLM

SEQ ID NO: 735 - protein, 58 aa, Homo sapiens
CITTMGKRYMHHPQIQMISTVNLLVIHLLSHQPVCSLALSLCKMGPTILLTFGVHQMG

SEQ ID NO: 736 - protein, 43 aa, Homo sapiens
CTNWKPQFKLWRIKPCCKQSISFNGWNSSGRLCQSQWQSFSPV

SEQ ID NO: 737 - protein, 43 aa, Homo sapiens
TIKHKKIIEVACKVSLELLLQQKSRLKTKKRMKTFMNLLHQMT

SEQ ID NO: 738 - protein, 109 aa, Homo sapiens
DKIWGLGAQHSYLLQENLGQHTIHSLLQVPGGDHSMTLQRLIPCKQKKSERCLLVCLLLYMHHPQIQMISTVNLLVIHLLSHQPVCSLALSLCKMGPTILLTFGVHQMG

SEQ ID NO: 739 - protein, 26 aa, Homo sapiens
SLASKKSQKGASWFAFFCICTIPKFR

SEQ ID NO: 740 - protein, 24 aa, Homo sapiens
CSLALSLCKMGPTILLTFGVHQMG

SEQ ID NO: 741 - protein, 89 aa, Homo sapiens
TDWMMQSMCCGTMLWDLPPVCLLVTVIYIVYWDHPIMHQLEASIQTMEDQALLQAVDQLQWLELIGKTLSVSMAIIQSCLVQSLLQAQT

SEQ ID NO: 742 - protein, 80 aa, Homo sapiens
EPEGMLLEAHRQVMHLERLWHLFILLTIPAVVFRQIHQHQLDHLHLSQVPVSGQDLEGKHLHPQAMKTHSTPCSLEWRIV

SEQ ID NO: 743 - protein, 72 aa, Homo sapiens
EPEGMLLEAHRQVMHLERLWHLFILLTIPAVVFRQIHQHQLDHLHLSQVPVSGQDLEGKHLHPQAMKTHSTP

SEQ ID NO: 744 - protein, 63 aa, Homo sapiens
PLELSSTLSFTNRHKHESSTNVQLSSRQYQQFTLRCCLTHSSHQWIRQHSRNQRECCWKLTDR

SEQ ID NO: 745 - protein, 48 aa, Homo sapiens
ILSPNPIMKQKLSLISTKLKNLTTSSPGPFKFLDTLFQLSMLKCLHSP

SEQ ID NO: 746 - protein, 42 aa, Homo sapiens
FRLTAFQQCLPFCNGPVYHDHRCTYKWQWETRSLGRTYWAAV

SEQ ID NO: 747 - protein, 42 aa, Homo sapiens
RLLGHQPSTSSLWDSICHLESSKSLLLPFPSCINCKCLSWVF

SEQ ID NO: 748 - protein, 39 aa, Homo sapiens
PTRSQTLSCPPSSCLSRPLRFPPLSSLYLLELSFLPFKH

SEQ ID NO: 749 - protein, 24 aa, Homo sapiens
HPYRSRWKREREDCRAFCHCSGNN

SEQ ID NO: 750 - protein, 24 aa, Homo sapiens
MEHRHQCRYQKNDFQFPCGSLRLS

SEQ ID NO: 751 - protein, 14 aa, Homo sapiens
KKQKQCIRFCHQIL

SEQ ID NO: 752 - protein, 66 aa, Homo sapiens
YSMHLVPGDHRCLLQFIWTPKRNSICLSKKSRLMGSSESLRSMLKAHMACLVRGILTLAGSMESPT

SEQ ID NO: 753 - protein, 45 aa, Homo sapiens
STAGAQPQRRTTFPADAPVLVLRTAPFSLMLTLPRQSQQRQSMLV

SEQ ID NO: 754 - protein, 44 aa, Homo sapiens
SLISERESTMKLRLALFLMNFKEQIVKSSLPKPWKKHPVPHPKV

SEQ ID NO: 755 - protein, 115 aa, Homo sapiens
WCQNSLLWMQEQTDHQTEKEAVTRGEKCWMEDRLLTCEQIQVIPEKHRNSKMTGKDVETRQQNETFHQQRLISSKRIFYLIVDLLFQHQIIPEIPVPQAQCHQEDQEADKENKQM

SEQ ID NO: 756 - protein, 25 aa, Homo sapiens
NTSQDICAEKPTQMIFHHLLCRHLL

SEQ ID NO: 757 - protein, 85 aa, Homo sapiens
LLHQLLHGRQWKQRQQPHYLQSPRAAYSLRHHSAHPVKPQQQHEQWQRGLWREALETTGTAETRSGTSSVQHRGAKQAEQRLSSK

SEQ ID NO: 758 - protein, 74 aa, Homo sapiens
PKSEGWAFCQSIRAAYSLRHHSAHPVKPQQQHEQWQRGLWREALETTGTAETRSGTSSVQHRGAKQAEQRLSSK

SEQ ID NO: 759 - protein, 62 aa, Homo sapiens
SSTTSCAATCYKVTYCPIQDTAGSTTCSGAKTPFYGCKNRQIIRQKRKQLQGERSVGWKTGC

SEQ ID NO: 760 - protein, 48 aa, Homo sapiens
TTSKYHEIYSDWEKCSSGGQYRHTHSKWTYYRLPCREAVFLRWQSRKN

SEQ ID NO: 761 - protein, 42 aa, Homo sapiens
HIKQGLVKRMSLLVVIKNASLWISSVIDLMTAEMVQMSKDAE

SEQ ID NO: 762 - protein, 125 aa, Homo sapiens
LNVRKISFGAKIKPTVFQLDGCVMEFMTVWMAVMKRTVKEEEIYVELMSSFAIILSANYISGCVMERTTVETTLMKPLICVSNFFVHPRDLTDAEITEYAYSRSKCAMGLMNAVTIQMKITVVVS

SEQ ID NO: 763 - protein, 41 aa, Homo sapiens
SLSAANKVYYIHIGSISLKIIYMEQDLKMVYFEFKNLAMVQ

SEQ ID NO: 764 - protein, 121 aa, Homo sapiens
PLEKPTLVHVPLTSIWQLIIGLAYPTAQPASFVAKLTNVFHSGGNVTPWMTVVMDLMNLMTVLNLDVSQADFSVGLDSVLYQLSSVMERMIVETILMNSTVTHMSACQVNSNVPRTRNVSQ

SEQ ID NO: 765 - protein, 24 aa, Homo sapiens
SRRNFLQKDPWQRKKASKQWLDLS

SEQ ID NO: 766 - protein, 207 aa, Homo sapiens
PNSYAKVEDALAANGTATLMTTVGTGVMRWAVFTLALIISSDVPVADASQATGPVMVTMTVGTSVMKPRSIVLKKRFILLLVVTEMNFSATLMVIAFLICGAVMEKKTVKMVVMKKVAMVPYDCVTTKPSFPVGVQGDASTKHGCVMEILIAKISQMKMTVTVSCVDHPSILVLMTPQSACSQRNSAMGKRIVLMALMKAISVMSVR

SEQ ID NO: 767 - protein, 22 aa, Homo sapiens
WTIKEKIDTLSFKADKLDIFMV

SEQ ID NO: 768 - protein, 89 aa, Homo sapiens
LKLRMLGESEFIKKELNQQSEAMHVKSIHMECQGAVHTSVYSAAVTKLGLVAAGLASTWEVMAGHAKDQRMSCSSFMGKDAQELLEEWT

SEQ ID NO: 769 - protein, 77 aa, Homo sapiens
SGCGAWPGYSRRPDSRLDSRKHILDRQQSGPNRSGQTRWLPKNYTNSRSHGTPQGHCFGPKIWNSFLDRLGCKFSSH

SEQ ID NO: 770 - protein, 49 aa, Homo sapiens
TRHLGEPASLTSPGGSAPCDSTGTTCETSKWTPVPASESHASFSRDEFI

SEQ ID NO: 771 - protein, 42 aa, Homo sapiens
PVPEAVCHHGEAQGGLLRDPPARWACHQHPAPHRRPRPPAQL

SEQ ID NO: 772 - protein, 115 aa, Homo sapiens
IHSTEKCYGGSCCSSSSNSSSNNSSNSSSSKGVPAWLGAWRGTASSSSLKDPEATHRPCSSSSACSSISPSRAAPWARWRLRWDSLARWGSRGWGQTAPPTSSKPCSSGFCSNSR

SEQ ID NO: 773 - protein, 105 aa, Homo sapiens
PHVLGERPVATSTHGTSCSLPNEPLCPDEQHGLSARDGHFSFPNASASEHDGCTHQQHDGPGARSEPVSATEPVPVIQRGDECGHGAAASPNRRVTGTGAWCCSS

SEQ ID NO: 774 - protein, 213 aa, Homo sapiens
RGQQPGRATVKEPPGVTPAEHPALHPVAGARVPVPQRQLLAAILPEDEAGGAAHQGLQTQDQRGLPGVQAAHRPLLLPRQALPRKQMPRALLPQHQTQAPPAADPAPPAAGPAHAPADGHHEHPQRASAESAFSYLSTARDPHTAAQHTPDAAAPCPAPTLTREHVTSWLPQRGPDSAPHHGVHREAYQPGAGPPTPGPAPSCSGGSGSADRA

SEQ ID NO: 775 - protein, 82 aa, Homo sapiens
SHGLWILGKCLNLSHIEPKLCLLLRKLTAWMSAFLECTSKNTALIAPLQTRGVCTFLIWIVFISSGHVASAQPFTMRSLLDI

SEQ ID NO: 776 - protein, 80 aa, Homo sapiens
APSNTCSQDSHRPRISLASRSPRPLVTRCGLQPLSSLHGPSPSLHIPARHHGYSPSLRHTTSHPRLVPPTPDSQSPWPAP

SEQ ID NO: 777 - protein, 70 aa, Homo sapiens
PRSLKPQFSPRLWLPLSHRSNSRRLCTPSLLAHRFPRQQPALITESLPPPRWPAQKPIPSSQDLTYLCWK

SEQ ID NO: 778 - protein, 125 aa, Homo sapiens
DGAIGAAARASSSNNSSSSSSSSSSSSPCPAAARRRKMRRRRKRRRRRRRRSRRWRTTRKTSSRRRQTTPQGRTTTRRRLWPPKAAKLPTAREDAKAASPAQWLMRPTARRPSPPSRAPSWPPWS

SEQ ID NO: 779 - protein, 41 aa, Homo sapiens
EPGETELSAPRQEPAAATTAAAAAAAAAAAAHAPQQPGGER

SEQ ID NO: 780 - protein, 252 aa, Homo sapiens
AEMRRRWWRRLKPYMPLGMRCPEGNAVAQPLSTTAQTPRASPLLTLRPPRTQGRMGPSPQPPWAPTGHPQGHPPHHRRTSRPPLSPPRPLKPPEPLRPHQHPHRPLHLLLWSPRRRRRRRPQQRPQWRRGRSRSPPRLRSWQWTQGRPRSPSRASARRKPRRGRPRARTRRPLRPRPRGRSRQRRRRAGAAGPPQPRARAPPRTATPVLPAVQTRWMRPRAATRTGCCPQGPASSPRLATPGPMPHPRSHWT

SEQ ID NO: 781 - protein, 235 aa, Homo sapiens
AEMRRRWWRRLKPLSTTAQTPRASPLLTLRPPRTQGRMGPSPQPPWAPTGHPQGHPPHHRRTSRPPLSPPRPLKPPEPLRPHQHPHRPLHLLLWSPRRRRRRRPQQRPQWRRGRSRSPPRLRSWQWTQGRPRSPSRASARRKPRRGRPRARTRRPLRPRPRGRSRQRRRRAGAAGPPQPRARAPPRTATPVLPAVQTRWMRPRAATRTGCCPQGPASSPRLATPGPMPHPRSHWT

SEQ ID NO: 782 - protein, 32 aa, Homo sapiens
RAGQGPPAARGAPLRAAPRSLCLSWVSRGRAP

SEQ ID NO: 783 - protein, 30 aa, Homo sapiens
RASWNRCLPPAPRTLTLSWSWCRHGCPRRS

SEQ ID NO: 784 - protein, 103 aa, Homo sapiens
SSERLPSPPSRSPKSMSPPGRTQLPPSQLPQPHRHRKTCSRRATPLSSLAAAPGARAGARHPPPTRRQRSLCSSQPSQPRPRSCLGTPLAGLPACPSPCPPVR

SEQ ID NO: 785 - protein, 26 aa, Homo sapiens
PSAPRRTAEAAQDPPMRRPPPSAPMT

SEQ ID NO: 786 - protein, 95 aa, Homo sapiens
SSERLPSPPSRSPKSMSPPGRTQLPPSQLPQPHRHRKTCSRRATPLSSLAAAPGARAGARHPPPTRRPSQPRPRSCLGTPLAGLPACPSPCPPVR

SEQ ID NO: 787 - protein, 85 aa, Homo sapiens
APPGGRSSHQASSPSPTATAKPAAGERRPSAAWQQPPGQEQEPGTPRRQGGREACVLPSLRSRGPEAAWGPPLLDFRPALPRAPP

SEQ ID NO: 788 - protein, 85 aa, Homo sapiens
GPPPPPHPFARLPHSHLPPTAHWAAPSMGSTLPSWSPSCCPRRPPGSPGQSGPEQTPAMPSSPSPQPAPGWSPPPPPARARSPGP

SEQ ID NO: 789 - protein, 77 aa, Homo sapiens
APPGGRSSHQASSPSPTATAKPAAGERRPSAAWQQPPGQEQEPGTPRRQGGLRSRGPEAAWGPPLLDFRPALPRAPP

SEQ ID NO: 790 - protein, 144 aa, Homo sapiens
LCGPLVTSASDLPPLHVQHHRGRFIFPVPGTLSILPRTRSKTPPHSPASRPCPLPPPCCLPVGPFPECSGSAPTTWSLPAIPGARHGPSASPLPQSCTSPGSRRAAAPGRSPAPLCTRLGTEPPPIHLTAPCCLPSAPTPGQAP

SEQ ID NO: 791 - protein, 117 aa, Homo sapiens
RLQHLPQYQQSVQLAKIQPLCPTPTEEKAGGSLRAHPWLSAPGCNCAPSLPDFSPLHPQCGISLVPRGTPLDLWTSRPGQEAATRNPRPLLLKFTASVVVPDSSPAPGTTSTWGGAF

SEQ ID NO: 792 - protein, 34 aa, Homo sapiens
KISRTESYYQSDPLENGPHRKTESHFGRCVCWCC

SEQ ID NO: 793 - protein, 29 aa, Homo sapiens
WRVSEEPVLSSLTSLRIELLLSSCSSRWG

SEQ ID NO: 794 - protein, 206 aa, Homo sapiens
SSWLRCCASGAAPATAGRIRFSREQPGPSASWPPGGTRPAAGRPGVSGQTQGAAAAQPLCVPSVWRSSLRGRSYGSFPASMSSIVTVWTPGYISIGLAPSACSTSQREIHFPSPWDPLDLTKNQVEDSTSFASIPAMPTTTSLLPTCWALPGVQWLGPHDLVPSCHPRSQAWALGITASPELHIPGLQESSSAWQEPSTPMHKAGD

SEQ ID NO: 795 - protein, 82 aa, Homo sapiens
ATSNPPHSTLLLAQCPYAGPGPLTAVDLEKAIAQNAVGTWQMGQPVTPAQGPVMALPVTLWSTARTSAYRGSMAAVLLSAAP

SEQ ID NO: 796 - protein, 13 aa, Homo sapiens
RSPRPGQIMMCGS

SEQ ID NO: 797 - protein, 74 aa, Homo sapiens
CSPTRCTCAMPVMTTIWSLDSSASSSWRVLDGPPAPACHWLARLGWRVSEEPVLSSLTSLRIELLLSSCSSRWG

SEQ ID NO: 798 - protein, 172 aa, Homo sapiens
PLGLVPWTRWCPQGKPRFPAMSTTTATGTTTTKSGSSGMAGSLAQKPESPSPGLLFLGHSPSQSHLLLISKSPDPTQQPLRGGSLTHSAPGPSLSQPLAQLTPPASAPVPAVCSTCKNPASLPDTHRGKGGGVPPSPPLALGPRMQLCTQLARFFPITPPVWHILGPQRHTP

SEQ ID NO: 799 - protein, 60 aa, Homo sapiens
VGDLRNPFFLSFFPCLQCGHLSWSSVTLMGTLRMVSGCYGSWSRNTEGVCNPDDFVEQPY

SEQ ID NO: 800 - protein, 150 aa, Homo sapiens
CNIRGFILVKNPINVKNVGRPLSVAHNLLNTREFTPMKSPMNVRNVERCLVMAHNLLNIREYTLVRNPINVRNVEKRLIVAHSLHDTRGFILVRNPMNVKNVEKPLVVAQNLLNMSEFTQLELRYSHGDFENGIWVLWIMEQKYRRSLQP

SEQ ID NO: 801 - protein, 56 aa, Homo sapiens
KGLYSEFTSFSASENSYCWSSVTLMGTLRMVSGCYGSWSRNTEGVCNPDDFVEQPY

SEQ ID NO: 802 - protein, 133 aa, Homo sapiens
CNIRGFILVKNPINVKNVGRPLSVAHNLLNTREFTPMKSPMNVRNVERCLVMAHNLLNIREYTLVRNPINVRNVEKRLIVAHSLHDTRGFILVRNPMNVKNVEKPLVVAQNLLNMSEFTQPSLQVNKIEVIFI

SEQ ID NO: 803 - protein, 43 aa, Homo sapiens
ANSHSWSSVTLMGTLRMVSGCYGSWSRNTEGVCNPDDFVEQPY

SEQ ID NO: 804 - protein, 223 aa, Homo sapiens
CNIRGFILVKNPINVKNVGRPLSVAHNLLNTREFTPMKSPMNVRNVERCLVMAHNLLNIREYTLVRNPINVRNVEKRLIVAHSLHDTRGFILVRNPMNVKNVEKPLVVAQNLLNMSEFTQVRNPMNVRNVGNLLFVVPSLLNIRESILVRNLMNVKNVEWPLLRVHIFPNIKDFTLVRNPMCVMNVERPLRVAYYLYNIREFILVRNHINVRNVGKPLFVVHS

SEQ ID NO: 805 - protein, 195 aa, Homo sapiens
HNIKVFILVKNPMNVSNAGRPLVVIHNSVFIRDFILVRNPMHVRNVGRPLLKAHNLFYIIEFILVKNHINVKNVGKPLFVAHNLPDIKKFILVRNLMNVKNVGRPLLRIHNLHYTRDFILVKSSMNVKNVGRSLLSSHNLFCIREFIPVRNPMNVRNVEKLLFVAHSFLNIRKFIMGKNHMNVRNVEGPLFGAHY

SEQ ID NO: 806 - protein, 59 aa, Homo sapiens
RPQAVEGTLFALLASVLLISELAFLESPPWTSKKQSADQCKEYLPMYCSILLEFPLQLE

SEQ ID NO: 807 - protein, 54 aa, Homo sapiens
ILQRSLCLTKVSMNALLSAVQVLDGHRHFLTYQSPLRSSKCLTMLQSLLEREQF

SEQ ID NO: 808 - protein, 53 aa, Homo sapiens
LIPWGELEFYLGAGNYKFQLLKSLMQHSIHVWRRMLLGLQRKNTICKFTLDQP

SEQ ID NO: 809 - protein, 52 aa, Homo sapiens
QAESLAFLSWKMAHCWLLLLLHPMTMGSTSVWQSMKLEPQKENITSKSMFLQ

SEQ ID NO: 810 - protein, 39 aa, Homo sapiens
FPSWLFSKAHPGLQKNSQQTSARNTYLCTAQYFWNFHSS

SEQ ID NO: 811 - protein, 17 aa, Homo sapiens
SQPERGHCVFEWAFSND

SEQ ID NO: 812 - protein, 16 aa, Homo sapiens
KKLQCQHLGPPKYWWF

SEQ ID NO: 813 - protein, 16 aa, Homo sapiens
RYTHCQPDCACSPHFY

SEQ ID NO: 814 - protein, 39 aa, Homo sapiens
VLEKITSSMLGGPPMEPAYSSPKSPRQCLAVTSLWMIST

SEQ ID NO: 815 - protein, 37 aa, Homo sapiens
RPRPPPATPWPSAPIPRSASHAAATATSLCGICTTRH

SEQ ID NO: 816 - protein, 85 aa, Homo sapiens
IATRWLHSHSGRGSQYFVHLGPGGSNPAHQGGADVLGPRLLRPGHQPRFQGLLLMLQRRQHRCVGSAQPDTSEAIPGPHRRSQLY

SEQ ID NO: 817 - protein, 76 aa, Homo sapiens
GNSRATQTEPAVLTFLMMAPSSGRVVWTTQSGPGTCARGGSCSSTTSPPRSSPWGTAPPGSGWQWAWRAAMWRCCT

SEQ ID NO: 818 - protein, 62 aa, Homo sapiens
EYLPFLQTWQESLGGNLHTPSTLLQTVRCSLSLFPPTPSSDPESPGMLARSTPSTTGRWCAL

SEQ ID NO: 819 - protein, 151 aa, Homo sapiens
PASKPGRAAPAPAAAPGRAPCPTAASARTSAPCTYPCRAPASLFCLPSSECQQQPYPCQRGQEPPAQLTHSGQTNLPLDERVSTKHKAENQQLQLRRKLRWRQEPAGAGFVQARAHGLHERAAGGAGERVPLQPLPVPAAPGGDGQSAEPH

SEQ ID NO: 820 - protein, 57 aa, Homo sapiens
APDQDLVPESPHEVQKGSEGQGHANVIGGPVSKSQPRAPRSRWLSELYAFAGQQRPV

SEQ ID NO: 821 - protein, 52 aa, Homo sapiens
APVAPALLQAPPGYLRAAPRLLPCVPAQLRTPATPTEALHGGRGGRRGHPRL

SEQ ID NO: 822 - protein, 117 aa, Homo sapiens
LTSPTLPRAPWTMGVPGRWAAATTTGRGLGSRTPPTRTLPATILLREEFRKHPSSPTCDSGLGATRQESLPPPTFFLWLLFFFFFFRFFLPFPSFLFSLLRPALRFPVSPLVGKAFL

SEQ ID NO: 823 - protein, 97 aa, Homo sapiens
TLCIRWSTASRMSPSRPRPSPSPPRVPTGCPPPPTLRPCPAAHPRHPHRSATRRQGRAQGAPPTMTRTLMACRATAAMGPHTYREAPSSWGAAMWSP

SEQ ID NO: 824 - protein, 83 aa, Homo sapiens
APHLASLQAWESRPCTRRRPRPRPLPHSRLSPHLSPLHLPLPRPRLPLLPPLLRMPATTLPLPTRPRAPCSTHPQWPNKSSPG

SEQ ID NO: 825 - protein, 121 aa, Homo sapiens
EHPGRARTACAEDTWPPVAWAWPSLPGQWARGQDASGTGGCRLGAREARTQVRGEAGRGRPAPPPTRPPPRPPQHSPAQGAGGGRGHPQGPEQLRLGPGTTQPWGKVPRLLRECWRCPQRQ

SEQ ID NO: 826 - protein, 224 aa, Homo sapiens
GHLAASRLGLAIAPRTVGTWPRCQWHWGVPPRGTGSTYPSQGRSWTRPACTTTDTSTTTSTTAQPGPRSRWRPRPPAGPRAASPGAWNHTAMGQGPEATQRVLALPPTPVMASPTVGRWAWRAKEMPRRLSRGRAPAPRCQVPRRMRRRTRKSCSGSLRGKRRSAGTAGPATGLRGRGSHSPMRTPDPCPLSTPGPALSSGPPCSPPTSSSKTPPCHPTQLPTP

SEQ ID NO: 827 - protein, 171 aa, Homo sapiens
MKMRNGSVTRTWMRTMAETLLPPEDSLRSCSWRQLPRGSPPVDGTAKAESSGMDPGGSQSTPIMSMPAMPWPQPPVPTTASSRACPAMQTPCPSRTAAWMGSPHTGSVSSTAGRCRRACRSMGGCPYLTFPARTGCRRRSAWSLRSSRRSSSTAWRLCSARGRPRRSWRSG

SEQ ID NO: 828 - protein, 65 aa, Homo sapiens
SACAWRRKVRTAIHRQGPQGRVTSCLPPPLGTTSRPAVWTWAVPGSGMHTRRTLRASWTSTYSVC

SEQ ID NO: 829 - protein, 65 aa, Homo sapiens
TVQRRQRVQVWILAGASQPLLCQCRLCPGPSHQCQRQRAAEPVQRCRHPVPHGQQRGWDPPIQDP

SEQ ID NO: 830 - protein, 64 aa, Homo sapiens
SILPCLTRPRPKSRPLWRKTPIPPSLSLIFIWNIRGQARRAPKSVVTRALGQGQGRAYLDTCRP

SEQ ID NO: 831 - protein, 41 aa, Homo sapiens
RMERELKKWSIQTCLSARTGLSISCTTLNSPPLKKMSMPAV

SEQ ID NO: 832 - protein, 35 aa, Homo sapiens
LCSRYSLFLAWRLSSVLQRFRFTHVIQQRMESQIS

SEQ ID NO: 833 - protein, 21 aa, Homo sapiens
KSGAFRLVFQQGLVFLSLVLH

SEQ ID NO: 834 - protein, 240 aa, Homo sapiens
AVPICQAHPLQHPTWRVPNSQLSLWLLGSRLSQTTWHVPLHLQTEFLACLRKLWIRNPRIRRGNPLSRRPLHPFPKRSPGLKIVSPFVTQLKVFTPKSHSPLKRSPKSRPSGFNFHVSNHPGWLKVSPLTRYAPGSSPPRSPPAGVGLAPGPSQTLKPVLCRSEGREVTTAIERRPPLPSEGGVARVEVAAGPPMREVAEAAAVVMVVRPVATLSPGEARAPLESVRQIYSEHNYCRLIL

SEQ ID NO: 835 - protein, 22 aa, Homo sapiens
RGGHHCHRRGGWPGWRWRRGHR

SEQ ID NO: 836 - protein, 169 aa, Homo sapiens
SPLVQSRQVGPWVIRAMLQAKGRSFLALGMWLQPFSAPGLRTRCLFLLRSLQFFPVGSWDQAQTPCLVGYRLQGKTGLQSHMPLLAASRMRRLLWGVLLRQMPRTGKLLGIVPWNWWVTWKGCPLSWTCPSGNYPESQGRGSVSLWSLLLSPPNSASSRHFMGSFLNSN

SEQ ID NO: 837 - protein, 58 aa, Homo sapiens
PDQYASNNFSASSRGNKHSSHGQNHLYSWYTDYFPSQAVQLCFHVSRTPNTPCSCCKC

SEQ ID NO: 838 - protein, 39 aa, Homo sapiens
KKKKRIKQKKQKKKKKKRKMKRKKMKKKTPKKIPRKRTR

SEQ ID NO: 839 - protein, 13 aa, Homo sapiens
SRKNRKKRRRKER

SEQ ID NO: 840 - protein, 71 aa, Homo sapiens
ATVRLIPITEAALQARFIGATCPRTWIQPCLFTGLWILQRLLTCFRDSFHQLQVTQVSISFTQWRTQDRQS

SEQ ID NO: 841 - protein, 42 aa, Homo sapiens
AAWRVQIPECAISSLHQESTPSVNSNSCRGLKKPRKSGQQML

SEQ ID NO: 842 - protein, 38 aa, Homo sapiens
REGFVCQTETQVCQSPKIWRKSFQSMGSSSPEPEISQS

SEQ ID NO: 843 - protein, 34 aa, Homo sapiens
AYNITFKSISAYHENKRKKMKIKSLFICFSFSLV

SEQ ID NO: 844 - protein, 80 aa, Homo sapiens
KNTYMKLPEDILTFMPRNSFSLLKGIKLLLQNVAKLLIKLPACCQSSMNFGMKGRLRLPNRDSSVPVSKNLEKELSKHGQ

SEQ ID NO: 845 - protein, 69 aa, Homo sapiens
LNLQKHVLLMSQLKIVTNHFIPFLETNYAQLQLFVKPMVKWLTAVQNKNLREMNASCNTKMTTQTSPDW

SEQ ID NO: 846 - protein, 228 aa, Homo sapiens
SACLCASASRIITGRARPLSVCQLPVDTQATLSTASLRVTSLTSTMWSSLFATLGIWLRGLLGPNAWPAGNGVTCCPPAESSTVQILDTKKIVFVRSTPAARTGSASAPLCLTGATTASTSWAPQCSAAREMAHGTVPAPSVSWCPVAIRAPRLTPRCLETVILWEQWCGTAASASVLWWETAPACVGWMDTGLAPSLTAQEPAWEFAVTLGSRLMASVWGTALIQAL

SEQ ID NO: 847 - protein, 107 aa, Homo sapiens
SACLCASASRIITGRARPLSVCWCPVAIRAPRLTPRCLETVILWEQWCGTAASASVLWWETAPACVGWMDTGLAPSLTAQEPAWEFAVTLGSRLMASVWGTALIQAL

SEQ ID NO: 848 - protein, 219 aa, Homo sapiens
QVHRSRISLSAPIIKCGSSSRLMAVAVPWDSRLLMKRSSRAVAVTLAYLHMAGGKAPGFTTVTHSSLSASPPLSWWDRRQSHAKRITNGRLRSQAACSPASSTSPARLGLSCLPTTQRTMATTSTVSGSSWPGLRAASTWPSTTLTWSLSLISWSSRMGPPPRRPSWAPSQETSFPPPSQAVATWPVSSSRLTTPQGRGASTSLLPPSDTTSARILAFQ

SEQ ID NO: 849 - protein, 350 aa, Homo sapiens
CRARGDGSWGAAAAPRGGLAAKPGFRRLCRAPGAAGAARRRQRRRLCCCCWAVGCSASRPPRARTARSNCTVPMGQLRAQGSHMATPITPTARGPSPRKSSTESSLCSSPLPWKRTLMSCRCLMVHPSQRICVRGSQAFSCQPPLLVQPPPSLCASSATMQSVPKASTPPMKFSPATHVGTQGGCPMASSRVQPSTSVTRSATAATLASSWRATPCSPATLALRTAPRGTSPCLPAELMMPVVGPCGARVASSPAPTSPRSTITMPTAHGPSWLSWGTPSPWCLLTSSWRMVTTFWKSLGQKAPPSGSPEPASQPPLSAARTGCDCTSHRMATTGSADSVPNTKSRSKLS

SEQ ID NO: 850 - protein, 306 aa, Homo sapiens
ASPPALDGKFKATTQDQLARTARSNCTVPMGQLRAQGSHMATPITPTARGPSPRKSSTESSLCSSPLPWKRTLMSCRCLMVHPSQRICVRGSQAFSCQPPLLVQPPPSLCASSATMQSVPKASTPPMKFSPATHVGTQGGCPMASSRVQPSTSVTRSATAATLASSWRATPCSPATLALRTAPRGTSPCLPAELMMPVVGPCGARVASSPAPTSPRSTITMPTAHGPSWLSWGTPSPWCLLTSSWRMVTTFWKSLGQKAPPSGSPEPASQPPLSAARTGCDCTSHRMATTGSADSVPNTKSRSKLS

SEQ ID NO: 851 - protein, 251 aa, Homo sapiens
FIQERNPTNVKNVAKPLTSSQILLHIKKFILESNPTYVKNVARLLPNPQPLLHIREFILEKNPTNVKNVEKLLTDPQNLLNIKTFILESNPTNVRNAAKLLTDPQILRNIGKFIPKRNPTNVKNVAKLLNTPQPLLHIREFTLERNPTNVKNVAKLLTDPQNLLNIRNFILERNPTNVKNVAKLLSNPQNLLNIRKFILERYPTSVKNVAKLLNTPHPLLHIKEFILGRNPTNVKNVAKLLADPQNLLNIR

SEQ ID NO: 852 - protein, 78 aa, Homo sapiens
ISANVKNVKKLLTNLQSLLNIKEFILVRNSTNVKNVTELLTNSQTLLNIKKIMLERNHTNVKNVAKPLTSPHTLLHIR

SEQ ID NO: 853 - protein, 62 aa, Homo sapiens
FILERNPINVRDVTKLLTNLQTLLNIKKYILERNYRTGMCDNDFDNTSNFSKYKGNHTGEKF

SEQ ID NO: 854 - protein, 146 aa, Homo sapiens
AERSSNRQKSKWKLPAKTWTKPRRRCSAYPKRRRRGRGLGMRVPVGLVEAPTGAVKRPKPLRGRGLVSVSVFVEPGLRLKGQTTLLSYPPIKLAAPPHHPAAVLPGSEFPGQHLGLDPLQLQLRLQFLPLFLSQFLPQYPFQPQIQ

SEQ ID NO: 855 - protein, 144 aa, Homo sapiens
ASWLEKVSFPWRSYCSSMQEPMPQALGAVKMRMKMRLMLIALTVNQRGPWKRKSLLRRIVAVSQTLWRTGVRMRKMNIQRRKKQVEVQHQRNLSLKSLRMPNHRAKQMKRRKMMILGWSTCLPGMKSRVRQMQAVGLLLQGPLL

SEQ ID NO: 856 - protein, 49 aa, Homo sapiens
HTDIALWSPQPSLHCYLVWWPPASTPAPPTTSFPFLSGLPGGKAEAAAV

SEQ ID NO: 857 - protein, 48 aa, Homo sapiens
GLFYCAELRWMLRSRCPKSTSMLSAAGSPSVNAVSMMTSWHRPQLRRH

SEQ ID NO: 858 - protein, 128 aa, Homo sapiens
KRQIRRECWGTWPLREATSPQPISNSRPSESCLICPWRNLLAHPCPLPLKRRKRLWPASRLIFWSRHCVGQKMKRISVQPPRPRLNRWLSLQNLMRTMGFLLVRERKLAGLGLRMRRCPGLSRKLLPS

SEQ ID NO: 859 - protein, 114 aa, Homo sapiens
HCALVPPALPPLLPRLVAPGLDASPPHHLVPLFIWTPWRKSGSGSGLNAWNGFSNLVRLMGPWHLCMGLKSWISVPCPNLLPAPSALVLLAPATPPFGLIPRLPTGLYCFPSSD

SEQ ID NO: 860 - protein, 30 aa, Homo sapiens
VRAMAWSSHPQQHLMSHFRSHWRLTGPRKS

SEQ ID NO: 861 - protein, 421 aa, Homo sapiens
SCVLYSLSSIVIFTPHLCPHHTSCPSLGSTHHPHLSPLDCFCFGPSSVDQCDSTIGTCCPSGSWTSLLGTIWCFPVSISLDSRFGHSSIPVFISDTWSPSVVGSHLFTCSRVELNRGPSMLTCPGASFGSGQSFSVSTKSSSSSGFPSGSSIFCISGSSHPSGSYGGSTDSNSGSFSSSSSGSSSGPGTIARCCSCPGFITDSGSSYGSIVYSRNLFSLSFTGTSSNPCVGSIINSNYATSPGSVTSPEPGFYADTGPSPSFSTHSWRLISISDTLFGNGEPPGTLSNSDIVINSSIIPGTNSSPDTVFGTRTTTGSNSDAVSGSSTPSGSSFSSGPSPSSHADFGSSIVICFTPGPSFSADTDLEPCPSSYPGPGRSSDLGAGPSLHTVPSFPGIFPCGFGIWCRSLACHHGIPAACFQG

SEQ ID NO: 862 - protein, 28 aa, Homo sapiens
NVGGGGPPRRTGLQQMLGEVWMRHPHPP

SEQ ID NO: 863 - protein, 84 aa, Homo sapiens
LVPRCASLLWGSPARCKGMWCTSCQQGGSTISSASLPMWPSSRPWPRPLALPLSLCCLLRPPAPPLPLLASAFRLLLTRCHQPW

SEQ ID NO: 864 - protein, 69 aa, Homo sapiens
LKIPHWMDLQAPQMVPQCPWRGSAYPRLLTWLTRARSGRRAMPKLQNRPSMRPRSRLGLLSCGRRVSGH

SEQ ID NO: 865 - protein, 52 aa, Homo sapiens
WQTIQQCLPPLLAQLVAVVAAVVVEELTTLSKMHCREPGRLQQKLEVMQGHH

SEQ ID NO: 866 - protein, 40 aa, Homo sapiens
LEHLNLSSQQNGYWTRLLKKEDQLLASIMAMDREMQFKKS

SEQ ID NO: 867 - protein, 209 aa, Homo sapiens
GHLYPMGPMVSQAPMDLLGLQGLELQWDHTTLHLIILDHQARLLMVLQPHMLPRDGEMHIHTGSSRLLLIQLRQERIQIQQLGLLITLTIINSKHSHHQQPLQVHQLQLKLMDKEISRIQPQLDRLIIPRLGKSTTRKWVRQFLLRLGLLQVVSQIIVQPGLSIIDNKQPIMPRQVPRECHSILQHLRANNKKWTIQYLLHCVGEKNLC

SEQ ID NO: 868 - protein, 24 aa, Homo sapiens
SKKYKMMLVFAFSLSQMMGQHPKG

SEQ ID NO: 869 - protein, 17 aa, Homo sapiens
FVIKAVSEKFGMSMGQE

SEQ ID NO: 870 - protein, 66 aa, Homo sapiens
YEVIYNSWHSTTDRLCSATHRRKDWWPSKSFRATCTPWAPWCPRPPWTSWASRAWNSNGTIQPCTL

SEQ ID NO: 871 - protein, 150 aa, Homo sapiens
RKDRCPTAACRTCTTKVPPEQCLTWAWGSASSFPMEPVTTEGMNLMGSSIQAKALPRDSRRMEGTSPACTHSSRITNAIWTACTGPQPSATRATCTTCSTAASSRRCTTSMEAPTRARTAGPSRASTRIPTAGRGCRARGRSRHTESRLR

SEQ ID NO: 872 - protein, 47 aa, Homo sapiens
AQQSVHPGPRAAKGIRATRRSRLSPHMRPLISPASRGAHLPLLLALL

SEQ ID NO: 873 - protein, 41 aa, Homo sapiens
FFFTTSIQRESEHRRPMRKRRMRTRGWPAAKMSGGGTASRS

SEQ ID NO: 874 - protein, 33 aa, Homo sapiens
CRNVQTSRPGADPGEADSSSPRASREKASTADL

SEQ ID NO: 875 - protein, 80 aa, Homo sapiens
WGAQCKLQRPRARYGYQCQQPDAWTRAKPAMWCCAPGTNAISWDAEQTISWKYEQHDPQFSWHVSAGRARNGAANANCEP

SEQ ID NO: 876 - protein, 74 aa, Homo sapiens
PPHGNGSNFELSSQCIRVHEQPRGSEQPGAVAFLPTCVPSSLQHPGGPISLSCWLSCRKQPVSIWPNLSCKYPR

SEQ ID NO: 877 - protein, 68 aa, Homo sapiens
KSSIFSTCLPLSARSNVGRSPRRKSSAPGTPKSSPSSSRHLLLTRDPCKAHRPPSQLAAIPWQRFQVT

SEQ ID NO: 878 - protein, 62 aa, Homo sapiens
ASHQCHRKEVLWQAHKETLRWLSMDLNRQDHPCRLILLLGARCMLESVAFSRVTQVGLTVHR

SEQ ID NO: 879 - protein, 143 aa, Homo sapiens
CPLGPLVPGSAWLPPVSMSTRPSATTTRSSGREGEGPAWQTGATRGWVCASAELGPLMLSVRWRGHLLQARASPGCPPTMRALTWWRVIMAAVRRSCSSFPFPEQGRREAKDWTWLISSCLVGGELSVAGRVGGKPSAQAVVP

SEQ ID NO: 880 - protein, 120 aa, Homo sapiens
LHQTAMMVPPMPLYWSMQIAQELKWSQWKLLVVTLESTSKPSSLMPGAMSSVWCLSKTSTGWSTFMGSTSASRPGVGAALIFIPRSGAFTYHLPNCLPSNSRRLFTECSLVSFPLLAAAW

SEQ ID NO: 881 - protein, 37 aa, Homo sapiens
GPKGTSCWAASFCCILPRMSPRALKAAWMLSWSTKRL

SEQ ID NO: 882 - protein, 34 aa, Homo sapiens
PRFSREWPPLLVSNHQGEQRLCLPSDPGWMAGDC

SEQ ID NO: 883 - protein, 102 aa, Homo sapiens
RPWMLTFLSRTGRSPATSQRETPWASLASAKLEMSGGFPQGRPWTASIQPSTCSESQHLMASSRLRSLWRSLSWTSMITAHSVHSFSILARFMKMYFQDTSF

SEQ ID NO: 884 - protein, 26 aa, Homo sapiens
VTQILQRMAPPTRFESPRGTTALPSE

SEQ ID NO: 885 - protein, 93 aa, Homo sapiens
GTIGHLSGWLRVWSESLLRMSMTIPPNLSICPITQSSKMAQSQGMSSFRYLPLMRTWGQMGLLHMNLQKITHISELTPILGTYHSRNPLIIKL

SEQ ID NO: 886 - protein, 21 aa, Homo sapiens
ATASGLQCAPQTPASCGPFPL

SEQ ID NO: 887 - protein, 91 aa, Homo sapiens
VPAPATTSTNRNPARPLFQMNSSHLDPILSNGQWSAVCPPDSRQLRSLPTLTMSLSLREPGPARRWCTLAEPWSGPLLTPGTNAGNTPTPK

SEQ ID NO: 888 - protein, 61 aa, Homo sapiens
QWLGWGAPVLPACWHWTRSLQHQPRYRNDSDSGTPGPRICILLLVDGISSGQGFCAPLFCN

SEQ ID NO: 889 - protein, 289 aa, Homo sapiens
PVVWTSSAARIRAAASQRVGSVTERMTVGMARMSPRKSVMNAPVSHTSSAARTTAACPAAGSATTTTIAVTTPMKRAAPLGPAPRVSSPVPTAAASRGAGNAMETTTARTARTRKTAPPAVTWTSSSARAATASPCAGAVTQTPTAWTAATRRPAALACGPAPWTSSSATTPCASRWPGSAMARMTVGTTQMRTPRSVPGSCALPTGPSVARMTASVCGSGANAMARTTVGMGLMKRTVSPPQPTPPTAKTRRSFCAGTSAASPPPCAATCSMTAGTALTRRTAASTPS

SEQ ID NO: 890 - protein, 40 aa, Homo sapiens
PAPPTSSSAPLPNGASPGSGSATGTMTVWMAVMSPPTAPR

SEQ ID NO: 891 - protein, 33 aa, Homo sapiens
TSAAAVSKGPVWSTSRVGMSPATARMAGWPPAV

SEQ ID NO: 892 - protein, 87 aa, Homo sapiens
SAPATRAGSWNLTARAAAAWTPSSRSSFSPTAMKSGASIFTKETTASWCPACATPSPWTSTSARAPSTGPTWWRTRSTAGSCWTTEP

SEQ ID NO: 893 - protein, 84 aa, Homo sapiens
RCTGGRSTGLTGEQTHWLRPTSGPATMSPWYRGPTPSPLTCRCTTPPASPWLPIPVRPMGARAPAPTCVSSTTTGPCPAPAPTS

SEQ ID NO: 894 - protein, 169 aa, Homo sapiens
TMAAAAACAWPPLGAASAPVLRTRCWTQTASLAWRTHPTCLHPSASQASLPVPTAAASRSAGSVTETTIAWTTVMRPQPSAISTPAPRTDSSARTTGASPTAGSATGTMTVGTVKMSPMPLVQPAPAPPTSSPVPVAAASPSPGRVIWMTTVGTALMSLLRVPIPPASP

SEQ ID NO: 895 - protein, 66 aa, Homo sapiens
TGLQATSTGWRVTWIRSRWPSWMGPSGPPCWPVTLSTQGQSHWIPGMGSCFGQTGMPACPALRQPP

SEQ ID NO: 896 - protein, 58 aa, Homo sapiens
LQFFTRSSSKYFGEFQRYRKQNELYIKNCNLGVKYKKTSLFIKWLTYKLCQYLLERCN

SEQ ID NO: 897 - protein, 148 aa, Homo sapiens
GPQGCGPRPQPDLLQRPNHRPAGDKRCRENHYHIHVDGAPPSHFWNHHHQWQEPTDRPVEGQNGAWCVSAAGHPVGQPHRPGTFAALCFHKGASVDQEGAASASQSNSSGCGLNSASAQTDPSSVWRPEEEALPWHCFHGHVEDRGSG

SEQ ID NO: 898 - protein, 47 aa, Homo sapiens
NSRNSETGSISYPDDTRQIDEHFFKFKGDYISPNEKFIYIRQWRILF

SEQ ID NO: 899 - protein, 108 aa, Homo sapiens
SEGFSFPTFLLKSSKQPYFVAAPTPYCGLETIRNNTLQPPIWRGLAERGQDPGEHPSVWSGPLHRAGILHPVCIHRQLCGEGQGDWSQKVAAHKWPWLQDVLVHKLPI

SEQ ID NO: 900 - protein, 105 aa, Homo sapiens
RRFPQTLPWRRWCVQSCLAHQRMKLRNGATLEAATLSGQKPKTILSMQSAGCESTNRCLFSGNRVACFRRHSQAWAIVWRLSGISLKKRASPGRWWKLCTLHCSC

SEQ ID NO: 901 - protein, 26 aa, Homo sapiens
GSCREYLVKTSLKASRMSTASHSFMA

SEQ ID NO: 902 - protein, 22 aa, Homo sapiens
LTFLIVSNHFSVWRNTWEDYLY

SEQ ID NO: 903 - protein, 22 aa, Homo sapiens
RHRDICSKYYFLKFGKDSTIDF

SEQ ID NO: 904 - protein, 11 aa, Homo sapiens
KNLFVHQMAHI

SEQ ID NO: 905 - protein, 129 aa, Homo sapiens
RRAGCLPGWAPRIVRAPAGAALIPFHGPPPTPGIPSAPFPRLFWRPPDSPAALWPTFPQRRGPPWRPPLRSWGPPAPPLLHRRAAHSRVPSPRSWGPRLGPAGRIGGNFRGPHPRAHRVQLLGADSWKQ

SEQ ID NO: 906 - protein, 37 aa, Homo sapiens
GQHGHSLGPFFIRWLRQEKEKGQPTQGVCADSSGLAV

SEQ ID NO: 907 - protein, 100 aa, Homo sapiens
WQPRILEEVLLQHLAVRLRMRTAWTFPWTFLHPLAQAREGEGATYPRSLCRFFGIGCMSTVTMPILQSKKKRCCPSKHTCLRYRSVTGSSTPAAGSSLTC

SEQ ID NO: 908 - protein, 96 aa, Homo sapiens
KARKVLLQHLAVRLRMRTAWTFPWTFLHPLAQAREGEGATYPRSLCRFFGIGCMSTVTMPILQSKKKRCCPSKHTCLRYRSVTGSSTPAAGSSLTC

SEQ ID NO: 909 - protein, 96 aa, Homo sapiens
LLAKVLLQHLAVRLRMRTAWTFPWTFLHPLAQAREGEGATYPRSLCRFFGIGCMSTVTMPILQSKKKRCCPSKHTCLRYRSVTGSSTPAAGSSLTC

SEQ ID NO: 910 - protein, 93 aa, Homo sapiens
KVLLQHLAVRLRMRTAWTFPWTFLHPLAQAREGEGATYPRSLCRFFGIGCMSTVTMPILQSKKKRCCPSKHTCLRYRSVTGSSTPAAGSSLTC

SEQ ID NO: 911 - protein, 77 aa, Homo sapiens
WTFPWTFLHPLAQAREGEGATYPRSLCRFFGIGCMSTVTMPILQSKKKRCCPSKHTCLRYRSVTGSSTPAAGSSLTC

SEQ ID NO: 912 - protein, 64 aa, Homo sapiens
IWTKYEYTEWSFQHSSPYSTGPQPGLQWISASSGCCTQTGCRDGASGKTYSLTHFQAKQFSEMS

SEQ ID NO: 913 - protein, 61 aa, Homo sapiens
AVIPGISFGSSISDLPYHCDCIERCPFLSLPVGRCGTKHRYTADSGQKLHRHLSHVPRGHL

SEQ ID NO: 914 - protein, 49 aa, Homo sapiens
CLWRPKRVQILWRISYTMKDTHVPASMETVLRGIEKRPFTSSAQEKAQF

SEQ ID NO: 915 - protein, 96 aa, Homo sapiens
KTWLMNTTTRVAVVDVLRVADLVEGLVPETTDKVAVPAVPASAAAAQAAAAVAEVATVAAEDLVEVAMEAFTTVMDMEEIITPRGLTGGVTEPALQ

SEQ ID NO: 916 - protein, 95 aa, Homo sapiens
KTWLMNTTTRVAVVDVLRADLVEGLVPETTDKVAVPAVPASAAAAQAAAAVAEVATVAAEDLVEVAMEAFTTVMDMEEIITPRGLTGGVTEPALQ

SEQ ID NO: 917 - protein, 23 aa, Homo sapiens
RCQQFQLQQQPRKQQPQWRRWPR

SEQ ID NO: 918 - protein, 182 aa, Homo sapiens
TLQIIRVEEVQPAVSTIKTVQGGVLAKIRMRIAVLDLVVIQEGSLASSVIVEVDQGEGLMIVDGVITMALAAVVTEVALANLNVVETVAGVTNQMKMIGQNHSHQVNAWNRNSFLEATLGLILRNTMTFQLRQQATTVLHILKVSVMLRWEKLSWETLSLLVILAQLQCKSMLFLLSKRKET

SEQ ID NO: 919 - protein, 176 aa, Homo sapiens
GTEKLLKVSTIKTVQGGVLAKIRMRIAVLDLVVIQEGSLASSVIVEVDQGEGLMIVDGVITMALAAVVTEVALANLNVVETVAGVTNQMKMIGQNHSHQVNAWNRNSFLEATLGLILRNTMTFQLRQQATTVLHILKVSVMLRWEKLSWETLSLLVILAQLQCKSMLFLLSKRKET

SEQ ID NO: 920 - protein, 23 aa, Homo sapiens
PRGLCTELLLRQRSWACTWRCCS

SEQ ID NO: 921 - protein, 94 aa, Homo sapiens
HQGLSQDSSRMDLLVSQLLTIITALPPGLEVGLHHTHLICLTTKTAIFSTTRLCRPIPDITGLFTMSLHSSLPFPIILLLSIGVPLLTLKWMFR

SEQ ID NO: 922 - protein, 20 aa, Homo sapiens
TEKLGVHLEMLFIRSTQVHI

SEQ ID NO: 923 - protein, 70 aa, Homo sapiens
QRSCRRRQRSWRRRSQACRRRLLSCRRRRRSWSSCWWLTAQCARLAPRSADRPQPLGCSPCAVGVARWAL

SEQ ID NO: 924 - protein, 63 aa, Homo sapiens
PRGAPIAPSPWAAAHAQWGWLGGRCSGETGAPGRGQPLVLVGGAGQGPALCHQAHQHCWGLLR

SEQ ID NO: 925 - protein, 57 aa, Homo sapiens
LGSFLYPWATWFYIRTVIELWPTWSYLRSVFQPRSAWLWLKSVFSLWPTGLWIWPVS

SEQ ID NO: 926 - protein, 280 aa, Homo sapiens
ASLLALVTTSLAQGSPLVTVSMGLAQVTPLATDNTALDQDSHLGVNDTDLAQVRLPTMVSMGLAPVSLRATADKGLDLASPLAAADMGPVWGTPPATANMGLAQVVLPAVAHMSLAWVTLLSLVNMSLAQDIPLLTVSMVVAQGTSVAKDSMVLHQDSHQPLTRRDLAQASLPAMATVALAPVSLLAMADMGLDLASLLATADTGLVQGSLPATANMGLAQDSPLVIVSMEVAQGKMGILIAKEEVTMMGEVLAHIFSVFLVALHPMNMSKSRGATFISE

SEQ ID NO: 927 - protein, 45 aa, Homo sapiens
SRPTWVRFRALFQLRPTWVWLRLVFQQWPTWVWLRSVFWIWSPRV

SEQ ID NO: 928 - protein, 45 aa, Homo sapiens
SRPTWVRFWALFQLRPTWVWLRLVFQQWPTWVWLRSVFWIWSPRV

SEQ ID NO: 929 - protein, 465 aa, Homo sapiens
VTKSLAQDSPLATVNTDLARVIPLPMGNMVLHQDSHRAVANMELPQVSLPATVSMALAQVSLLAMANRALDLASLLVAADMGPILGTLPATANMGLAPVGLQAMAHMGLSQASLPALVTSLAQGSPLVTVSMDLAQVTPPATENTALGQDSHLGVNNTDLAQVCLPAMVSMGRAPINLRATADKGLDLATLLAVSDMGPVQGTPPATANTGLAQVVLPAVAIMSLAQARLLVLGNTSLAQDRAIVSMVLPQVTSLARDDMDLRQGSHQAPANMTLAQVNLPAMVSMSLPPITLRAAADMALDLASLQATASVGLGQGSLPAMADMGLAPVGLPAVADMGLAQASLLALVTSLAQGSPLVTLSMDLAQVTPPATNNTALGQDSHLGANNMDLAQVRLPAMVSMGLAPVSLWATANMGLDLASLLALAVADMGLVPGSLPAMAHIGLAQGGLQAVAHMSLAPVTLLA

SEQ ID NO: 930 - protein, 43 aa, Homo sapiens
SRPTWVRFRALFQLRPTWVWLRLVFQQWPTWVWLRSVFWIWSP

SEQ ID NO: 931 - protein, 110 aa, Homo sapiens
VTESLAQDSPLATVNMDLAQVIPLPMGNMVLHQDSHRAVANMELAQVSLPATVSMALAQVSLLAMADRALDLASLQATASVGLGQGSLPAMADMGLAPVGLPAVANMGLA

SEQ ID NO: 932 - protein, 110 aa, Homo sapiens
VTESLAQDSPLATVNMDLAQVIPLPMGNMVLHQDSHRAVANMELAQVSLPATVSMALAQVSLLAMADRALDLASLQATASVGLGQGSLPATADMGLAPVGLPAVANMGLA

SEQ ID NO: 933 - protein, 110 aa, Homo sapiens
VTESLAQDSPLATVNMDLAQVIPLPMGNTVLHQDSHRAVANMELAQVSLPATVSMALAQVSLLAMADRALDLASLQATASVGLGQGSLPATADMGLAPVGLPAVANMGLA

SEQ ID NO: 934 - protein, 424 aa, Homo sapiens
VFKETFLANITPTQVSLPAMVSKTPTPISLQAAANVGLGQGSLPTMANTALAPDSLPAMTHMGLAQASLLALVNTSLAQGSPLVTVSMDLAQVTPLATDNTALGQDSHLGVNDTDLAQVRLPAMVSMGLVPVSLWATADKGLDLASLLATSDMGPVRGTPPATANTGLAQVTLTAVAIMSLAQARLLALGNMSLAQDSPLAIVSMVLAQVTPLARDNMDLRQGRHQALANMAPAHVSLPAMVSMSLPPVTLQAAANTALDLASLQATASVGLGQGSLPAPANMGLALVDLPAVAHMCLVQATLLALVTTSLAQSIPLVTLSMDLAQVTPPATDNTALGQDSHLGVNDKDLVQVHLPAMVSMGLAPVNLWDTADMGLDLASLLALAVADMSLVPGSLPAMAHMGMAQGGLQAVAHMSLAPVTLLA

SEQ ID NO: 935 - protein, 27 aa, Homo sapiens
PRPTRVWFRAVFQLRPTWVWLRTVLWL

SEQ ID NO: 936 - protein, 18 aa, Homo sapiens
HRSVFQPRSAWLWLKSVF

SEQ ID NO: 937 - protein, 358 aa, Homo sapiens
ASLLALVTTSLAQGSPLVTVSMGLAQVTPLATDNTALDQDSHLGVNDTDLAHVRLPAMVSMGLAPVSLRATADKGLDLASPLAAADMGPVWGTPPATANMGLAQVVLPAVAHMSLARVTLLSLVNMSLAQDIPLLTVSMVVAQGTSVAKDSMVLHQDSHQPLTRRDLAQVSLPATVSMALAQVSLLAMANRALDLASLLVAADMGPVPGTLPATANMGLAPVGLPAVADMGLAQVSLLDLVTMSLAHGSPLVTLSMDLAQVTPPATNNTALGQDSHLGVNNTDLAQVHLPAMVSMGLAPVSLWATANMGLDLASLLALAVADMGLVLGSLPATAHMGLAQGGLPAVAHMSLAPVTLLA

SEQ ID NO: 938 - protein, 358 aa, Homo sapiens
ASLLALVTTSLAQGSPLVTVSMGLAQVTPLATDNTALDQDSHLGVNDTDLAQVRLPAMVSMGLAPVSLRATADKGLDLAIPLAAADMGPVRGTPPATANMGLAQVVLPAVAHMSLARVTLLSLVNMSLAQDIPLLTVSMVVAQGTSVAKDSMVLHQDSHQPLTRRDLAQVSLPATVSMALAQVSLLAMANRALDLASLLVAADMGPVPGTLPATANMGLAPVGLPAVADMGLAQVSLLDLVTTSLAHGSPLVTLSMDLAQVTPPATNNTALGQDSHLGVNDTDLAQVHLPAMVSMGLAPVSLWATANMGLDLASLLALAVADMGLVLGSLPATAHMGLAQGGLPAVAHMSLAPVTLLA

SEQ ID NO: 939 - protein, 358 aa, Homo sapiens
ASLLALVTTSLAQGSPLVTVSMGLAQVTPLATDNTALDQDSHLGVNDTDLAQVRLPTMVSMGLAPVSLRATADKGLDLAIPLAAADMGPVWGTPPATANMGLAQVVLPAVAHMSLARVTLLSLVNMSLAQDIPLLTVSMVVAQGTSVAKDSMVLHQDSHQPLTRRDLAQASLPAMATVALAPVSLLAMADMGLDLASLLVAADMGPVLGTLPATANMGLAPVGLPAVADMGLAQVSLLDLVTTSLAHGSPLVALSMDLAQVTPPATNNTALGQDSHLGVNDTDLAQVHLPAMVSMGLAPVSLWATANMGLDLASLLALAVADMGLVLGSLPATAHMGLAQGGLPAVAHMSLAPVTLLA

SEQ ID NO: 940 - protein, 77 aa, Homo sapiens
LRSVFQPRSAWLWLKSVFWLWPTGLWIWPVSRPRPAWVWVKAVSQLRPTWVWLRSVFQQWPTWVWLRRVFWLWSPRV

SEQ ID NO: 941 - protein, 77 aa, Homo sapiens
LRSVFQPRSAWLWLKSVFWLWPTGLWIWPVSRPRPAWVWVKAVSQLWPTWVWLRSVFQQWPTWAWLRRVFWLWSPRV

SEQ ID NO: 942 - protein, 12 aa, Homo sapiens
LWPTGLWIWPVS

SEQ ID NO: 943 - protein, 70 aa, Homo sapiens
SRPTWVRFWALFQLRPTWVWLRLVFKQWPTWVCLRPVFRLWSQVWLRAVLWLQSAWIWLKSLLRLQKTRL

SEQ ID NO: 944 - protein, 66 aa, Homo sapiens
VCLPSLFRPRPTQLWIWPVSRPRPAWVWVRAVSQLRPTWDWLWSIFQQWPICVWFRLLFWLWSPRV

SEQ ID NO: 945 - protein, 65 aa, Homo sapiens
VCLPSRFGPRPTWLWIWPVSRPRPAWVWVRAVSQLWPTWVWLRSVFQQWPTWVWLRPVFWLWSQV

SEQ ID NO: 946 - protein, 41 aa, Homo sapiens
HFYICRSCKINFRRRISVWQKRPQFQGIFRCWRKIILITIR

SEQ ID NO: 947 - protein, 41 aa, Homo sapiens
NFHLHFFVESVVILMKTMEMGKTFNQSFKKFRKLKNLRQKK

SEQ ID NO: 948 - protein, 37 aa, Homo sapiens
LKYPVVRKMNKLFLVTGQNSTDMIKMLVNGKKGALVI

SEQ ID NO: 949 - protein, 36 aa, Homo sapiens
ELQSTMHWRERLWFQEFHFSQSNSRFCLPRRRYHQT

SEQ ID NO: 950 - protein, 105 aa, Homo sapiens
EMNLLYLGALRVRIQNLLTKVDLHLFIKLHLNLAREIFLNLLTVISDLFFLQRKDSGIAVHVWYKMRGALQNVLLVRIRENRVYLLLLFQHLPLLSLVLQRQVKL

SEQ ID NO: 951 - protein, 93 aa, Homo sapiens
IGFHPNSIFMPIRNRCTHRQCKAHLLVCSLRRCMVLLHCVLSLLQREFYRPGVMITLITMFNRQAQIHLCQNQDISQNLRLQLMLQDLQNLRL

SEQ ID NO: 952 - protein, 21 aa, Homo sapiens
FQICFFYKGRTVGLQCMFGTK

SEQ ID NO: 953 - protein, 79 aa, Homo sapiens
FLAKQVALLHLQILQNQLQEKDFSLAKKTPISRDFQVLEKNYSHHNTVKWPIKQTLPVTLRKMMMPIRLRTAMTSILNQ

SEQ ID NO: 954 - protein, 74 aa, Homo sapiens
PRVDLKAKWNLKNVNCQRTLISNSLQIAKSKISLLPFQRKNLQSTTHLKHQKRQKRRKNLKILPQMMMFSLYMN

SEQ ID NO: 955 - protein, 64 aa, Homo sapiens
QMQLQKLKCLAHLKQHQKQWFLLQSLYLVQSLLKAFLVVKNQNHLHSATVQPLGLCLDLVLMHL

SEQ ID NO: 956 - protein, 62 aa, Homo sapiens
CEMKQMLQDVLLVRIRINQVHLLLFQLLPLLSLVLQRQARLQRADLRECSLRRRDSGIAVCA

SEQ ID NO: 957 - protein, 61 aa, Homo sapiens
KDSILQSCIMKLKNMILLKNTYVLTLMCKRGIPKLTDFWVFFMNWKKTQTKPLNVTGVQWN

SEQ ID NO: 958 - protein, 58 aa, Homo sapiens
SPLRTGGPSASSTMRCGLSRRFSTSTSWAGAGAPTCSGWPASRSTSNLRASPWTSSRS

SEQ ID NO: 959 - protein, 133 aa, Homo sapiens
WCILEALRMRRKSRRKMMRQKTSKQPPTMLHLHASRPPGKEKPTNMFTTGMFSMVPAGQHGRRNLFKNTKAKRPLPQRRSTAITGLTAAGSRLQLTTPQRPPPRVPRPRGLLPPITTPLCIGRLRTYGNRFLR

SEQ ID NO: 960 - protein, 46 aa, Homo sapiens
TQSHALRRWGGGSCGRACSCGRGCGTPRGDWKRHTRRRSRSRPPRR

SEQ ID NO: 961 - protein, 125 aa, Homo sapiens
LSHSPWRSYSTRLHKQKQKKKTVPLSVPSQPSWMSSGIQSCGSAGSCSRLASTPPHAMAATMAAARWRTGRKSLESGCSWRRQRGGVRSASTCATCPWWYKRTKTSCSVWSVLCATWRNRSPAEG

SEQ ID NO: 962 - protein, 39 aa, Homo sapiens
RLAGGDSSLRKKKWSRKRRRTKASSMTSTSASIREGLFL

SEQ ID NO: 963 - protein, 32 aa, Homo sapiens
AILHGEVTLPDCTSRSKKRKRSHSQYHLSPPG

SEQ ID NO: 964 - protein, 81 aa, Homo sapiens
GKVCFSNNFLSNSEEYHEHVFQQGACPSRNRARVLEASGREGLPRGSALRQGGHQHSRQWIPSRKIRTLFEAWMEPHRPPQ

SEQ ID NO: 965 - protein, 173 aa, Homo sapiens
WSHCYPLQLLRYQTSLKGSLRQKIFLPFSAFEVLLRCPTAWCILEALRMRRKSRRKMMRQKTSKQPPTMLHLHASRPPGKEKPTNMFTTGMFSMVPAGQHGRRNLFKNTKAKRPLPQRRSTAITGLTAAGSRLQLTTPQRPPPRVPRPRGLLPPITTPLCIGRLRTYGNRFLR

SEQ ID NO: 966 - protein, 70 aa, Homo sapiens
RRGLSHTPKPRENWSRTPNPITTSPVPLSTTQSQGKLKVAMQKPANRCYPSGGRPSPLGPPSMASRSVAG

SEQ ID NO: 967 - protein, 66 aa, Homo sapiens
ILAWSFLPHAGLETKITFHTLTTYTLVLTAFGIAFLLRRRTSWKMWSTPCCKPMAPQGCRCWKATS

SEQ ID NO: 968 - protein, 52 aa, Homo sapiens
PGQRVGEAWKQSGESARWSSREPGQGCSWQPRKGTTSEGWQSGEGTSSKGWE

SEQ ID NO: 969 - protein, 126 aa, Homo sapiens
CRGAATETGSRHRHRCPRHPGRPSAIRSSSSTNTRCSTTNETGLLVWFQWSWNPPLNLPLCRLGPICPHLSLTCPHLSRHPLTTPRPHLSPTCLLLSRPLRSPHLPNPTWRPPLLTHPPPLPRNPI

SEQ ID NO: 970 - protein, 42 aa, Homo sapiens
LHHHRPPPLEIRQLSSKSLWRVGPKTRVLNSSKPPLSQIPLR

SEQ ID NO: 971 - protein, 121 aa, Homo sapiens
GLEAVGRKCQVVFKGARTGVQLAAEKGDHLGGLAVRRGDLFEGLGVEREYHPEELGAGREDHLEGLAVEKGDWEDQILVVIEVHSDQNQEMVGKKCIHITGMSLLGLHGTMEKSEGMKSFH

SEQ ID NO: 972 - protein, 99 aa, Homo sapiens
CPLPSLLQCHHLACPHLLCHLLYQPLFPHQGCLLLSLLQGHHQFSPHLPCLLQGHHQFFPHHLSLQQHLHLSCPSHHCLQLHLLQEYLPLEFHKGYLLS

SEQ ID NO: 973 - protein, 58 aa, Homo sapiens
EIRLPRILQASSQKIRRITLLCQLWMKIYFQSRLVCGRHSSSSNSNREVALQACLNLR

SEQ ID NO: 974 - protein, 56 aa, Homo sapiens
QEGETFDSFQKKRPGHRKYLTLEHSTHLCQPCDDSARAIAHPKRSPILRTSGSCFS

SEQ ID NO: 975 - protein, 53 aa, Homo sapiens
LVLEFEYMSEKKRTRDNHLPPPPHLHHFSSKLHVILALRTIIMQRNLILNSSP

SEQ ID NO: 976 - protein, 45 aa, Homo sapiens
NLILYPLSLERQSLKTDRQLSVAELNHLINPFYHTLFHQSRNTLM

SEQ ID NO: 977 - protein, 34 aa, Homo sapiens
WKQAWVFLLMLPHLLWCTSFPLRVPVMYEHLIVY

SEQ ID NO: 978 - protein, 28 aa, Homo sapiens
TSCFGEGFHSSRISFHRSLLDASTSIFL

SEQ ID NO: 979 - protein, 27 aa, Homo sapiens
AKKRGPETTIFLLLPISIISAANFMSF

SEQ ID NO: 980 - protein, 96 aa, Homo sapiens
KLNVILGVGFLILQPSPLFLGELQKAAEGMDIFRVTYCYLENRYNQSKRRRVGEAVLTSLFWIWKKMMKMIMRKLMILLMKLWMLFLTTRVRRLMM

SEQ ID NO: 981 - protein, 95 aa, Homo sapiens
SIFLSWIYLLWITIVISGMVVGGNLVGRLNLMFWGGFSFIQNLLPQVIIGCINQYLSINSNLPTIHWTKKGISSCTLCIVTCRGFIWCLQKRLWR

SEQ ID NO: 982 - protein, 79 aa, Homo sapiens
MIPWKIGVIIWMKNAFQKKVVQLSNHLSIPVSLGHIQIKIIKMLMKNMGLGIVRVPKKKWLFWKLGPFLKKPVIRQSKI

SEQ ID NO: 983 - protein, 50 aa, Homo sapiens
GKKFLKENLKKSNWTDLILLPAPKTVRSLPVFLLGLAQGPAQTYKQDWEN

SEQ ID NO: 984 - protein, 267 aa, Homo sapiens
HLVVERFLGSEEVVEGLLMVPHRHFMHEKDVMSGDLMGLQITGSVLMNIVPMDTMNGGREDLIGQDITIRITIEILESGLYNMGSITLLGVEVQIALMLMTPDMNLGLASSLHCPVWYTGISTGMILPGRYEAEGQSGITSTAGVGHHIHPSLEISLLRDWLAKHLDPQGPLAAAALEVDPPVVIQSAAAVVPAVTAVIPAVVQVMILQLDQFSLQQSLHPLPSCFHLWKKMSPVKVLASRSRIFQYALQIQALKMAFSMNLRNLEK

SEQ ID NO: 985 - protein, 43 aa, Homo sapiens
KMWMLLSVPGGLQHRQGRGNLGWWQSPLRKVRVPKRRMVYHPS

SEQ ID NO: 986 - protein, 39 aa, Homo sapiens
KRAPWNPRLLRRRQGVNRNVTEKMLAQTKTPLKPPLLKL

SEQ ID NO: 987 - protein, 36 aa, Homo sapiens
KQKSKNQRSRKAVQRWRMLACFQKSSLTCPLERSFC

SEQ ID NO: 988 - protein, 21 aa, Homo sapiens
RKNRPLKKTPNQREEDLETPG

SEQ ID NO: 989 - protein, 21 aa, Homo sapiens
SGESGERETLNTEGKSGKGQN

SEQ ID NO: 990 - protein, 186 aa, Homo sapiens
PSRWSWSRPWNTSQSSLRPLPLLPIRQMHQRALPQRTGTSLHTKQVKQSWLRPSAPSSMTFLGSQKTSQHLHLILENPRQICNPPQVHRRCSLLRKEWRQMRLYLASWKLRLLQNLLGLQSMLLTPQPAQQIPRKPEEIAVKPHTQCQKPKGLKKWKSLLFGKTKGARKQPDHAASETQTRKWWLL

SEQ ID NO: 991 - protein, 57 aa, Homo sapiens
SGAVYSNQLWSPLCSKLPPKWRLSGGAVPDGRALLVCGRPGEGNAWNPAARGAAILC

SEQ ID NO: 992 - protein, 56 aa, Homo sapiens
KSCSTFPTSSDQEIPTTLMSSHGKYPHLQPPGLTLYPVLVERTTRSSVSCSPIDRA

SEQ ID NO: 993 - protein, 124 aa, Homo sapiens
TAWEFRCAVRRMEEPGAFWTVALLTLKSTPIPSDGTRSPLLKIMLPVFALWLFCLPSQRKCLWTRGSPWPSLQWLLIHPLGTLMLPMSALLPPAISLLSETSVCRNVPNMRPVSSPLCKPNLGL

SEQ ID NO: 994 - protein, 38 aa, Homo sapiens
AAPQSTGPEESRLLLLVQVHLVSEDICRWSQGRAVSRE

SEQ ID NO: 995 - protein, 93 aa, Homo sapiens
TGQAPGMPASQGPAAGSQAPEHPRLLESVKIVCISMCSSLRMWPLTRLCWCSSTTPWTGRRVKDGRLSTAPSWLLLATSSWSLPATEWVSSAS

SEQ ID NO: 996 - protein, 92 aa, Homo sapiens
KRHSAKASISNRSRFDNRTFLPCGPQPGHCQWKSITIQPEALAFQAPVFSPAGKPMVPFSLCAGALFLSARRDNRECILVLHLHPLPRGTGV

SEQ ID NO: 997 - protein, 80 aa, Homo sapiens
IPGAKSFQAQESEVDSQGAPQTVKSKGLACKASWAASLLAPPCLSLLVLVRDISCLSSASTQSATVLMLRVRPFLELEVQ

SEQ ID NO: 998 - protein, 181 aa, Homo sapiens
PSVPSRGGSLRYLGIATVLTAKGGNWLRQVWSCYWMKFMTPFLLAWTFLPPSLKPPCTGYCRDGSSQFNQSSLADSDAPQNVKWSGLQQPALVTPMFQAAAEMATIRRCSARRKGPAGVWTPRGRKCMEPGSKGSRHLVLKANLVPPKGSRPCPDSTLGPQATSASTTCSLPQRKDGPLQE

SEQ ID NO: 999 - protein, 76 aa, Homo sapiens
PDLPHPAHPRSRSSLWTLGFSAQWWRDRANSFLSQKIFSKKPSEQFFPPEGWLVLPFSLPPTQRDSSKTFLEGNFW

SEQ ID NO: 1000 - protein, 52 aa, Homo sapiens
IWIQCLTTCWGWTAMDAGGRPLGWAFRRPEGGRLSLPCRGGPQCPMCQGPLR

SEQ ID NO: 1001 - protein, 48 aa, Homo sapiens
KPPPGQSHSSEREPNKGGMCRPFCSCPALQCGASCLPDWSQGDLSARV

SEQ ID NO: 1002 - protein, 88 aa, Homo sapiens
RMGFFLGWWGPMTGEALCYGLKEATAFSPHEWHWKTSSPLHCRTMQPTWVTLFLPCFCGVDAACFSLGLLDLDIEEKSSPSSLRKMGL

SEQ ID NO: 1003 - protein, 12 aa, Homo sapiens
GGPTMPHVPRAT

SEQ ID NO: 1004 - protein, 60 aa, Homo sapiens
LLQEGAPLGRRRSFPKGSHRAQMPRLALQWERLWGMESTVLRPNLGALAPLHILPCQEMA

SEQ ID NO: 1005 - protein, 136 aa, Homo sapiens
LVHIAGHHCRRGRLPISARGCLSSSARHPASPLSPRSPRAKRPVPSARRRSGTPRTRLWRRLVLEAPSMSSAHPSVSPCMRPSSSARSPSLGIPPTLLAAAYARRLERSCTRSAMAAWYTGSAAILASPNSGPTRD

SEQ ID NO: 1006 - protein, 21 aa, Homo sapiens
PFSGRDSGGWNQQFSDQTWGL

SEQ ID NO: 1007 - protein, 19 aa, Homo sapiens
GATRAFGSRFSNNTAVPTY

SEQ ID NO: 1008 - protein, 85 aa, Homo sapiens
TWNLERIYWNPRLPQLEDGPPLALLHPREPWTCLIPLLAWKKTLESWMEPLSCWGWGGCSIKPPLPRRWTTVLREPWHGMQEIRP

SEQ ID NO: 1009 - protein, 80 aa, Homo sapiens
VPGSPHSSPTIRCSLEWRRSTSGSVSNWGSTRPLSSSTPSCSSTLSFLGCRQLRNTCNSPSPMWCGSPASVPPLGAPPRW

SEQ ID NO: 1010 - protein, 56 aa, Homo sapiens
KKKTALKYIFVAVRAICVMKSFLIFRRWKSHSPLQIQLHLSHPITTSCSIPWCHLC

SEQ ID NO: 1011 - protein, 43 aa, Homo sapiens
KQGEDLVVSGKPSCLTNMWLSKYFQYRTNSHGKMNTKSTVCLE

SEQ ID NO: 1012 - protein, 40 aa, Homo sapiens
CVMKSFLIFRRWKSHSPLQIQLHLSHPITTSCSIPWCHLC

SEQ ID NO: 1013 - protein, 21 aa, Homo sapiens
SMMVAPSVHTKKWDSELELLS

SEQ ID NO: 1014 - protein, 20 aa, Homo sapiens
KKEACFKRLLAETCWNGNAL

SEQ ID NO: 1015 - protein, 72 aa, Homo sapiens
WELLQSWRLPSFLSPVLQVLYLVDQKLRSVFSLMLIGKKTEPIKLVLNRVMVTKINGGIVLLPGRIFLVPLK

SEQ ID NO: 1016 - protein, 140 aa, Homo sapiens
EHIREFTQVENPMNVVTVRKLLPIIQPSKYIREFTRGRNPMNVMNVRKHLPIIQPLEHIRISTQGRNSMNVVNVEKLFSRRHASVHIGEFTQGRNPMNVASVGKLSPRNHTSVDMREFTQGKNRMNVTYVGKLLSIRQPS

SEQ ID NO: 1017 - protein, 236 aa, Homo sapiens
CIKEFTQGRNPMNVTNVGKLSPKEHTSVHIREFILGKNPMSVMNVGKRLLIIQPSGHITEFTQGRNPMNVMTVGRLSPRHHISEHILELAQGRNPMNAVNVGKPSLRSHMLVHIREFIRGRNPTNVMYVGSHLPIIQPSEYIKEFTQGRNPMNVMIVGKRSPRNHTLVHTREFTQGRNPMSVMNAEKLLPKIQLSEYTREFTQGRNPMNVMNVGKLLSVRQLLGYITPECIPERKP

SEQ ID NO: 1018 - protein, 106 aa, Homo sapiens
DTRKQMQRWNSVVAVNMGRHHISKDIREFSWGRNPMNVLNVGKLSPRHHISEHIREFTQVKNPMNVLNVRKLSLTRHTSVYIREFTQGRNPMNVMTVGNLLPITQP

SEQ ID NO: 1019 - protein, 83 aa, Homo sapiens
EHIKEFTQVRSPMNAVTVRKLLPIIQPSEHIIEFTRGRNLMNVMNVEGLLPIFLFSRHIKEFTQGRNPMNVMNVGDLSPTIQP

SEQ ID NO: 1020 - protein, 153 aa, Homo sapiens
KEGKVPRAHQVQLAHQENVGQQVQLAQLVYQGARDLRVLLVQLERKVLLEKKVPKGLQGEMEFKVLLVSQGQLVLPAPLGKTETRVKLVSRDKKAARVTREKMALPVPQVFKDQLVPLELLEVMVNQVLEDSRGCLGKKVMRVPEASLDLLVQ

SEQ ID NO: 1021 - protein, 51 aa, Homo sapiens
RLRYCLQSFKASTTQCPNKTVISRWNFPRRLFNTIYSKTKKRNSVFPFIYI

SEQ ID NO: 1022 - protein, 36 aa, Homo sapiens [sequence omitted]

SEQ ID NO: 1023 - protein, 92 aa, Homo sapiens [sequence omitted]

SEQ ID NO: 1024 - protein, 88 aa, Homo sapiens
VHLVLQVYQVLKAQRVTKALLDPLARKVTVVFQGLLGLQVHLVKSFSLYQSCPPKKREDILKACKQMQMIIFLITRMEWKKYLVPSIP

SEQ ID NO: 1025 - protein, 185 aa, Homo sapiens
AVPKEKEERKGKLVHLELLDLQVPRGHQVMMALRVTRVLLVFLEILVLLGNLALQVKMVLVVTRVKMEILVNRVLLAHLVRLAHQVLLENEVLLELQVQREDKVKKVLRGKQVQKVLLEKPAQSVLRDLQESLVQKVFGASLVLWENKVSLELQAKMDHLVLWDLLAYLVSKVTLAPRVKRDILV

SEQ ID NO: 1026 - protein, 76 aa, Homo sapiens [sequence omitted]

SEQ ID NO: 1027 - protein, 50 aa, Homo sapiens
NHLCPPQVGKKLWQLCWIMTCLRLFTRNHFAVILLMYQKSPGRLVDGSSW

SEQ ID NO: 1028 - protein, 47 aa, Homo sapiens
CPRDGTAILKNIVPKRDHCAEIPTEVQLKMMTHLQEKKWNGVITVCF

SEQ ID NO: 1029 - protein, 42 aa, Homo sapiens
ILLHLAAGLPQIQELKKSWLLQKKRQCFLRVLMYIRRLLILV

SEQ ID NO: 1030 - protein, 34 aa, Homo sapiens
ANLSHKITGLCQQQKVKKNFRRDFRKFSNRMISL

SEQ ID NO: 1031 - protein, 33 aa, Homo sapiens
KNCDYALQMCPKSTTGSSVASSQRRIRTFQETA

SEQ ID NO: 1032 - protein, 25 aa, Homo sapiens
VRLDFVAFILEVSLSQLIRICLRSS

SEQ ID NO: 1033 - protein, 14 aa, Homo sapiens
FKKIYLTFPIIYLR

SEQ ID NO: 1034 - protein, 68 aa, Homo sapiens
VSHLFSWTVVLMRLWYIFLLVWKVMDIGGKEIGCHHHVAPLEIINIHKIVMMKKMNHRLKKRKWSLVW

SEQ ID NO: 1035 - protein, 48 aa, Homo sapiens
TMKRATTRPPPTPGCEEQGTGAPGTVHVHAYHKTFLSVLFFSPANLVC

SEQ ID NO: 1036 - protein, 120 aa, Homo sapiens
GVSARARGTLCRQHTPAPTARAQPHLPLVSTPSPCSAQAASTAHRMPPRPPSRGPAMPPAQPPITRTPTDSCSIVPLLSLHTANPALLSRLKAPWPGPRPLIAFRKIPENLDGETRNCRK

SEQ ID NO: 1037 - protein, 235 aa, Homo sapiens
VQQKSSFSGSHKMVKKISKMSLQQVSSWWTPVLGHYRNQEYLTHRIILQVKGPACSPRVHFSSIPNLKGLSSIRPATIATRPWPWGKPPLHSSRPEAHKPELRARASARARPAAPATWRGPSPRRRRRRRRGSRSRPAWAAPSTCPTRRPPPPPPRSTTPAPRCPRRRAGAPRWPRPRAVRPPSCSAAARPPRAPPTPRRAAPRPSSRPAAWPSPTAPARPSTSSCPRPACPRSA

SEQ ID NO: 1038 - protein, 33 aa, Homo sapiens
TMTVWCARWPLRCGTWPWTSEIRSSSANTPCET

SEQ ID NO: 1039 - protein, 87 aa, Homo sapiens
RPRLSEAPYEESQPEPGGPSAASTHRHLPHEHSPIFPWCRLRPLAAHRQPARPTECRRGHLPEGQLCRRPSLQLRGPLPTAAVLSLC

SEQ ID NO: 1040 - protein, 17 aa, Homo sapiens
PRPPPCSPPSPPRPSTS

SEQ ID NO: 1041 - protein, 126 aa, Homo sapiens
DGPPGWGHPHHHPGVQFGRPSRGHPEDLCGRPELLLSAGTLLRVHPDRVCDRGCGDAFHGGCRGGRLRETGPFASQCPVHLPTAQASQCGAAAGTAGGRHHTDHPRHPPGHGLPGGRAGDPQRRPV

SEQ ID NO: 1042 - protein, 206 aa, Homo sapiens
ALGCWTGLTAGRPLKPTRTTPPTRPATCPPTHSSSWRPSRTAPTSSLSSTSRTSTRPGTARCWHACAEKTPTTTPTWRWTCSAGTPTSTPLPLAPAWPPPWLRLALAGCYMLSSAETAGAVGGPVRASACSRWTRCTPRWRPTATPVTQAPGRPVTSSTSPSTAISSAAATRRAPARASHVARSTCPTRWAAATGSEAQPCCSVEA

SEQ ID NO: 1043 - protein, 87 aa, Homo sapiens
AAAAGGGAGPLPVLQPAEQQVFPHQFHPHPGEPAGVLGPRQGLLRVPADGGAARETGVLHGHHAHALPGAPGAVRGGQEPQADAAQV

SEQ ID NO: 1044 - protein, 176 aa, Homo sapiens
PGVPWAALLLLAQARQRGPGVASGLHSADPVGPGPDVTAGGPVEARQHPYALQCPGWSHPHPVQGGGLPAAGGQPAGPAWGAPCPPGGGEPGVAPGAADRRGGRGQVQERQREREGADEGHHRDLPDAAALSQGHTAAVCGQLLPERAGAWARGATCSQVLLRLPGRAGREAQHPG

SEQ ID NO: 1045 - protein, 70 aa, Homo sapiens
RSLGRSSSVSLAPRRHGARCFWRSPTGGPPCPTPASSSPTAKTPYCEPSSRYEALPVVAAASTSRVRASA

SEQ ID NO: 1046 - protein, 62 aa, Homo sapiens
DCGGEDAVQLDVHLPVPVPQGQCRGAPVQALQGHQTSGGKGPGGCGTEEGQVHSQRHGAAGG

SEQ ID NO: 1047 - protein, 234 aa, Homo sapiens
GVFPWVDQTAGSAWILPKQRRLGTPSSTSPRHSLCIMSCSQMDTPGTATWTPTWCGTGRPHTFCTQTETGLFWKGTGPAPVKALTAETALRATVAQCAAGVVSVGGQMETVVCPSPGKRGGNGEAFPVTVGGQPIHHMRNGVGPRAVGSSQSGAPTAPLSAAARRTTPVKGPRSPAATPSATADMGLRNGATTTTTTRLQTLPTGRRQETASAITGPQRPSPSLWKSQNTRPKS

SEQ ID NO: 1048 - protein, 33 aa, Homo sapiens
SACQWGGPRAETAQACSTPSHPATFPSSTSSQH

SEQ ID NO: 1049 - protein, 25 aa, Homo sapiens
ALGGRWRPWFAQALGREAETEKPFQ

SEQ ID NO: 1050 - protein, 156 aa, Homo sapiens
GDAHSRARSAEAASQEPGLLLETEAGRRGDQLASGGVQGQRRHRHALRLPTLRLFPAVPPVSTKDIGQARRRTHGDSHRQRHCLAQACLSQRHVCVTKAVILKSDPLSTLPLWFELSPGLFWFIWVGIKVLSTTKTKFLDFGGFFFLNDEKGIRLC

SEQ ID NO: 1051 - protein, 149 aa, Homo sapiens
CLASQVCPSGAGAVVASAPPLPSPRLSPAPASPPCPGPGVAVVVASAGSALRVLVEWVAMAAGASTTWGAPRGYPSALVVAASGTGLVLVLEAAMALEVVPVVDLVSAVELVVALGSVAELALEVASVALAFLSALLEVSKRSLSTRVS

SEQ ID NO: 1052 - protein, 28 aa, Homo sapiens
ETCRTWWKTSRTSMRMKSTSVPLLRMSL

SEQ ID NO: 1053 - protein, 22 aa, Homo sapiens
VCDAEEGCRCCLHEQGGAGGQG

SEQ ID NO: 1054 - protein, 53 aa, Homo sapiens
PRSWPTWGTCPRIQQLWRYRPLNQQPRRHRPLNQCPRRHRPLHWQPQRHRQLD

SEQ ID NO: 1055 - protein, 160 aa, Homo sapiens
RPRRHRPLHWQPQRHRPLHQQPRKHRPLNPQAWRHRPLHQQPWRHRPLHQQPWKHRPLHQQPWRHRPLKPQPWRHRPLHQKPRRHRPLNPQPRRHRPLHWQPWRPCPQNPVPQRPCPWNLLPKEVCSYPFLCPLLLTRAFPWQPAICPSTTQWGPQTTSL

SEQ ID NO: 1056 - protein, 83 aa, Homo sapiens
GLMSAVNVGNLLSIVLALLHTREFTLVQGLICAVNVGNPLARAVTSLNTGDFTLEKGLMSVVNVGNCLLIDLVSSNTREFILE

SEQ ID NO: 1057 - protein, 186 aa, Homo sapiens
DLMNVMNVENYLAGNLTSLYMREFTQEKGHMSAVNVENPLPVNPTSSHTGKFILEQGLMNVGSVGNHLLIALRSFNTREFTLEKGLMSAMNVGSFLARAPASLDIGEVTPEKGLMSAVSVGNPLVTTLASLNTEEFIPEKGLMNAVNVENPLARALTSLITSEFTVGKGLMSVVTVENFLPSTPTS

SEQ ID NO: 1058 - protein, 41 aa, Homo sapiens
HDCTKESVPSYPVRHVGRGGRECHRGDRREAETLGTYDIAW

SEQ ID NO: 1059 - protein, 243 aa, Homo sapiens
CTRPGPRPAAPMTTRTSCSTAPTRSTPRPCPPLPPAPAPPPFSTGSPWLQVGFRKTPARLLPGLSPQTFTARSLSTLGGPPRKNSASETSSSGSRAFLLPPATTLPCHPRWKTGRPCPRFPRRSLPACRQGTTPQTMASRRPKSTLCTAHRLPLSLSPRLQRASSQVYKQNLPLPPEPSCWFLPSKGPFPRTWTPPRTSRRRPPSSPRSPATWSRWTRVPSAPSSPRSPLSGPTPPSRRLPLA

SEQ ID NO: 1060 - protein, 113 aa, Homo sapiens
RHAFARRCQQRALQGGEAAAAVRREPAAEQQERRDAAESGQLPHDGEPPVRQRHLHFQRGELDGELRRGRRTILRTFQFSRRQQHGLRVRKRPQAQGQEPRATEGHGPRQGRV

SEQ ID NO: 1061 - protein, 85 aa, Homo sapiens
GSAIQRPRQERRQAQGEAPGGRRPDDDQLREDAVPEGPGDRGAPQAAQGEDEANGEAEAPVRRPQAQGEGEAGRRRAEEGSGHSC

SEQ ID NO: 1062 - protein, 79 aa, Homo sapiens
KRTKFQKRRRRFLKKIKKNSKKKRFIGKILLLTNIVTKISFWRMKTPNLAFLTISEIGGFLTCPIHPLISKGRTAGTRQ

SEQ ID NO: 1063 - protein, 340 aa, Homo sapiens
RSVAARVASRTSPTATLGRAWSRGNGTTQHERRRRRMAPIRKGRRRQNQKDTKRNPVTRTKVRNQSWKNVRRTKNLINVLKRKKIPRKNIKTHMAKTKKGKRLSTKGKRRRRRLSLGSSQKTSLKKKMTRKAKRKAGTSQTSSQMRVRTTETAAWGAGSRWERPATCRGRTASRRRRKDGRPMPPTDTGSLLTSSTLRGRRTRSPETGERTEGLPTRGETKKRKSLKSTRRRRIKSPQKSTRTGRTEPQWTPRKIRKINRSSPRRLKRSTLPKTRLKANTKRSRTKNIPRRGSPREVPTRKKACLKSWKKRLSMSTEKTPTIKSARSPLTASRTEGRSRG

SEQ ID NO: 1064 - protein, 57 aa, Homo sapiens
RRKAGRHRATRLPRDSRGRRSQGRQGRPWGWRERAPRTPRASRAPRTLLQTRQADLH

SEQ ID NO: 1065 - protein, 53 aa, Homo sapiens
PSVWQVALWPSTWTVRSSRECRLLGPHGAWSWSLAPGSSWLRRGERTLTSSRG

SEQ ID NO: 1066 - protein, 122 aa, Homo sapiens
WRRGAPGHGRGGGASWTCSRPWSCCSGSARPPRSQSASARRWGCCSSLGTPRPSRSPRRMTPTSGWPTSLGQMPTVAKWPGTTSPASSSVTSHCCSTSGQPQRAQGCCSPSRTRRRPWSCWA

SEQ ID NO: 1067 - protein, 118 aa, Homo sapiens
RGRRETEVMQDRKAKGGSPGAAVSSAPACPAPPAPQAHVATLGFQVPRERASGASPAHLDLRDPPASATRGARALPAPQAPQGPLHFLALTGRLSAFPALRAPLGPLGPLEPWAPPQG

SEQ ID NO: 1068 - protein, 37 aa, Homo sapiens
NPGSPRHPPSPRHPWLEAAARKIPEVKKSRSRPRWLR

SEQ ID NO: 1069 - protein, 240 aa, Homo sapiens
PGTAVLGSPTWLTLWGRVLLITLPCSGLTPRPPPVAACPCHPPCQSAATWASHASGCPTTSTTRAASRCGPGHGRGGACCRRTATPSSPGSSACCWSPHAAASRRPPRHPAASSARPCRMRVGAAWAGAGCPSPVPRSRPRRMGTVCSLGRLQSASARRWGCCSSLGTPRPSRSPRRMTPTSGWPTSLGQMPTVAKWPGTTSPASSSVTSHCCSTSGQPQRAQGCCSPSRTRRRPWSCWA

SEQ ID NO: 1070 - protein, 212 aa, Homo sapiens
TAPTSQDPPAFLVCLGARVPPGFLASRDPQALREERGPQEGLGRKAAWVKQAPQDIRGAREPPVLLVLVGRAAWQEPPDLLDHQAPLGPLGPQDQDSPLDLMTWKAPGGPSGQQPEALMGHRDLPACRDLRGILACLGCRGRREKLEQMESPGSPASLAERALLGPRGQRETEAAGEKREIQGRTESGSRASLAPPDPRDLWSTCRSRTDPS

SEQ ID NO: 1071 - protein, 87 aa, Homo sapiens
GGSWRAWAAGGEGRSWSRWSPRVPRPPWQRGHCWAPGAKGRQRQPGRKGRSREGRSRAAGPPWPPRTPGTCGLRVGAGRIRPERAGT

SEQ ID NO: 1072 - protein, 187 aa, Homo sapiens
TWPKASGASSSCGMTLSPLRAWPGRKPWSWRLLWAPLPSLGLPAPPRRMGPLSGPAVAFLALRAPTQPRLAPCLHPPHRLPPWAGPGHHSRGPQCHHHLQSASARRWGCCSSLGTPRPSRSPRRMTPTSGWPTSLGQMPTVAKWPGTTSPASSSVTSHCCSTSGQPQRAQGCCSPSRTRRRPWSCWA

SEQ ID NO: 1073 - protein, 72 aa, Homo sapiens
GECPAPQDLQGPQALQGLLFTTAMCLLSPAAPGLQDCQGIRALQDPRAPKEKWAPPDHQGSFRLTFFSWRLK

SEQ ID NO: 1074 - protein, 165 aa, Homo sapiens
CRTERRKGGARGRRFLRLQPARPPRPPRPTWLPWDSRSQGREHPGPARPTWTSGTPRHRLRGAPGPSRPPRPPRAPFISWPSQADYQRSRPSGPPWAPWAPWNHGRLLRGEALGYTPGHAGPGARGSRGLAHLRGRAGGALRPRAERVPEGPAGGPDTTPTRDGQ

SEQ ID NO: 1075 - protein, 45 aa, Homo sapiens
TWIWSRTSNSALRSAPLNRSLPHPHPLINPWAAVRAAPPAAQVRI

SEQ ID NO: 1076 - protein, 114 aa, Homo sapiens
VPAPTEPTPTGIGAAPGCTPRSTTAAPSPCRLPAARLRPPARSVCRPVAPVAMAPPRIVSSHGDLVLRCLVPPAMAVSSPRMSMAPVPAISGVPSAVSLRIPWATPHQPAVRRS

SEQ ID NO: 1077 - protein, 29 aa, Homo sapiens
GATTLMSCLTPNPQWRAAVVSSYLAQVTT

SEQ ID NO: 1078 - protein, 208 aa, Homo sapiens
TCHQWGTPTPAAPPTATTALRTPSTSQSSPTTHCQDPLSTPSAPGSRRRVPGISTSAFPLALVAFSMLQQQMILPLPPAATAWVGDTAGLGWSPAFHIPTIRFCSPICLERWTQLLRPIAAWPGPRGCPWGIPRPAPYLGPESSSSSSSPCCTLQSPRARGNMSILNLGVISLATCLARWLSTAHLLSGVHPSSSQLPERKRLALRST

SEQ ID NO: 1079 - protein, 80 aa, Homo sapiens
CLPTHQEVAVEADCRDTGTPPSCPPAPTQRRVWKCTPWSVGGGTTAQTAPPSTRMMATCPCPQGWPQCPVAERAVETICP

SEQ ID NO: 1080 - protein, 65 aa, Homo sapiens
HANRHCCRGGEPAQGHHGCCLLILSSLCFPDWASRGSRAGCPLVPAGGPTRTWGHERLHPGEPQS

SEQ ID NO: 1081 - protein, 148 aa, Homo sapiens
PGGPGWPSGCETSGGPPARGSQPQRAPAQGAEAQFEDAQSGPQGPQAGPERPQGGSDSPRCEDVSVQHGGGRPGPESKAGWCAAGGGPVPGRQGGDCQRQQVQNAQVQDAIIRGVGPRQVHGGLGGCVCAEGGGRREPLLHAGGPQGH

SEQ ID NO: 1082 - protein, 56 aa, Homo sapiens
KGCDCQRQQVQNAQVQDALLRGVGPRQVHRGLAGCVCAEGGGRREPLLHAGGPQGH

SEQ ID NO: 1083 - protein, 56 aa, Homo sapiens
QGRDCQRQQVQNAQIQDAVIQGIGPREVHGGLGGCVCTQGGSRCESPLHAGGPEDH

SEQ ID NO: 1084 - protein, 56 aa, Homo sapiens
QGRDCQRQQVQNAQVQDAILWDVVPRQVHRGLGGCVCAKDGGRHEHSLHAGGPQDH

SEQ ID NO: 1085 - protein, 53 aa, Homo sapiens
RLLRVGSACHRETWILPFLVPQQGVAFKTQKRPAVTVVGEDLVQQQVPQEVRV

SEQ ID NO: 1086 - protein, 48 aa, Homo sapiens
CPQAGPERPQGGGDVPQPGRVSAQHGGGHPSPRSQAGQYAAGGGPVPG

SEQ ID NO: 1087 - protein, 133 aa, Homo sapiens
APLCPTGGPGWPGGPEAPRGPRSRGSWPQRAPAQVADAQFQDAQSRSQGTPDRCQGPQAGPERPEDGRDGPRRGGVSARHGGGCRGPRSQVGWCTAGGGPVPGRQGCDCQRQQVQNAQVQDAVVRGVCPRQVH

SEQ ID NO: 1088 - protein, 47 aa, Homo sapiens
PVPSRQGHDCQRQQVQNAQVQDAVVRGVCPRQVHRGLVGCVCAEGGG

SEQ ID NO: 1089 - protein, 45 aa, Homo sapiens
QKRKWPPKTASSKCPSSRCHCSGRQPQASPWRPRWMCLRRRWRPT

SEQ ID NO: 1090 - protein, 40 aa, Homo sapiens
CTAGGGPVPGRQGCDCQRQQIQNAQVQDAVIWGVCPRQVH

SEQ ID NO: 1091 - protein, 40 aa, Homo sapiens
LPKTAGSKCPSSRCHRSGRQPQASPSRPRWMCLHPKWRPT

SEQ ID NO: 1092 - protein, 40 aa, Homo sapiens
LPKTANSKCPSSRCRHLGCLPQASPLRPRCTCLHPRWRPM

SEQ ID NO: 1093 - protein, 40 aa, Homo sapiens
LPKTASSKCPNSRCRRTGRLPQASPSRPRWMCLRRRRRPT

SEQ ID NO: 1094 - protein, 40 aa, Homo sapiens
LPKTASSKCPSSRCHHLGCRPQASPSRPRWMCLSRRWKLM

SEQ ID NO: 1095 - protein, 40 aa, Homo sapiens
LPKTASSKCPSSRCHHSGCRPQASPWRTRWMCLRRRWRPT

SEQ ID NO: 1096 - protein, 40 aa, Homo sapiens
LPKTASSKCPSSRCPPSGCRPQAGPSRPRWMCLRRRWRPT

SEQ ID NO: 1097 - protein, 40 aa, Homo sapiens
LPKTASSKCPSSRCRRLGCLPQASPSRPRWMCLHPRWRPT

SEQ ID NO: 1098 - protein, 40 aa, Homo sapiens
LPKTASSKCPSSRCRRSGCLPQASPLRSRWMCLRRRWRPK

SEQ ID NO: 1099 - protein, 40 aa, Homo sapiens
LPKTASSKCPSSRCRRSGCLPQASPSRPQWMCLRRRWRPT

SEQ ID NO: 1100 - protein, 40 aa, Homo sapiens
LPKTASSKCPSSRCRRSGCLPQASPSRPRWMCLRRRWRPK

SEQ ID NO: 1101 - protein, 120 aa, Homo sapiens
PVPGRQGCDCQRQQVQNAQVQDAVVRGVCPRQVHRGLGGCVCAEGGGRSEPPLHAGGPQDHGPLHSAPFCRPGGPGWPSGHEAPGGPGARGSRPQRALAQGGYAQFQDAQSGPQGPPDRC

SEQ ID NO: 1102 - protein, 37 aa, Homo sapiens
RWKLTGASPPCKGILRPLTSAFSPPPPNWRSRLARWT

SEQ ID NO: 1103 - protein, 34 aa, Homo sapiens
GRQAGPERPQGGSDSPRCRGVSAQHGGGCPGPEG

SEQ ID NO: 1104 - protein, 34 aa, Homo sapiens
LPKTASSKCPSSRCRRSGCLPQASPSRPRWMCLR

SEQ ID NO: 1105 - protein, 34 aa, Homo sapiens
PVPGRQGCDCQRQQVQNAQVQDAVVRGVCPRQVH

SEQ ID NO: 1106 - protein, 34 aa, Homo sapiens
QPKTASSKCPSSRCRHSGCRPQASPSRPRWMCLS

SEQ ID NO: 1107 - protein, 31 aa, Homo sapiens
ASLPCRGTSRPLTSAFSPLPLTWRSRLAKWT

SEQ ID NO: 1108 - protein, 31 aa, Homo sapiens
ASPPCKGTLRPLTSAFSPPLPNWRSRLARWM

SEQ ID NO: 1109 - protein, 31 aa, Homo sapiens
ASPPCRGTSRPLTSAFSPLPLTWRSRLAKWM

SEQ ID NO: 1110 - protein, 31 aa, Homo sapiens
ASPPCRGTSRPLTSAFSPLPPTWRSRLAKWT

SEQ ID NO: 1111 - protein, 105 aa, Homo sapiens
GPQAGPERPQGGSDSPRWRGVSAQHGGGCPGPEGQAGWCVAGGGPVPGRQGRDCQRQQVQNAQVQDAVVRGIGPREVHQGLGGCVCTQGGGRPESPLHAGGPEDH

SEQ ID NO: 1112 - protein, 29 aa, Homo sapiens
QGRDCQRQQVQNAQVQDAVVRGVCPRQVH

SEQ ID NO: 1113 - protein, 28 aa, Homo sapiens
QVQNAQVQDAIIQGVGPRRVHRGVGGCV

SEQ ID NO: 1114 - protein, 102 aa, Homo sapiens
HPHSAPLRPTGGPGWPGGRETPRGPRSRGSRPQRAPAQGADAQFQDAQSGSQGPPDRRQGPQAGPERPQGGGDGPRRGGVSAQRGGGRRGPESKAGWCTAGG

SEQ ID NO: 1115 - protein, 102 aa, Homo sapiens
PQHSVPFRRPGGPGWPSERETPGGPPSRGSRLQRAPPQGADAQFEDAQSGPQGPPDGRQGPQAGPERPQGGGDGPRRGGVSAQRGGGRRGSRSQAGQCAAGG

SEQ ID NO: 1116 - protein, 102 aa, Homo sapiens
PQHSVPFRRPGGPGWPSGRETPGGPPAQGSRPQRAPPQGADALFEDAQSGPQGPPGGCQGPQAGPERPQGGCDDPRRGGVSAQHGGGRRGPGSQAGQCAAGG

SEQ ID NO: 1117 - protein, 26 aa, Homo sapiens
GLGGCVCAEGGGRSEPPLHAGGPEDH

SEQ ID NO: 1118 - protein, 100 aa, Homo sapiens
PPHSGPFRRPGGPGWPGGLETSRRPHARGSRPQRAPAQGGDAQFQDAQSGPQGPPGGRQGPQAGPERPKGRGDGPRCGGVSAQRGDGCPGPRIHAGWCAA

SEQ ID NO: 1119 - protein, 22 aa, Homo sapiens
REPPLHAGGPEDHSPQHSAPFR

SEQ ID NO: 1120 - protein, 22 aa, Homo sapiens
RPLTSALSPPLPNWRSRLARWT

SEQ ID NO: 1121 - protein, 22 aa, Homo sapiens
RTLTSALSPPLPNWRSRLARWT

SEQ ID NO: 1122 - protein, 88 aa, Homo sapiens
CGGFSAQRGGGCRGPRSQAGWWTAGGGHVPGRQGLDYQRQQVQNAQVQDAVVRGVCPRQVHRGLSGCVCAEGGGRREPPLHAGGPQGH

SEQ ID NO: 1123 - protein, 88 aa, Homo sapiens
CGGFSAQRGGGRRGPRSQAGWCAAGGGPVPGRQGHDGQRQQVQNAQVQDAVVRGVCPRQVHGGISGCDRAKGGGRREPPFHAGGPQGH

SEQ ID NO: 1124 - protein, 88 aa, Homo sapiens
CGGVSAQRGGGRQGPRSQAGWCAAGGGHVPGRQGRDCQRQQVQNAQVQDAVVWGVCPWQVHRGLSGCVCVEGGGRREPPLHAGGPQDH

SEQ ID NO: 1125 - protein, 88 aa, Homo sapiens
CGGVSAQRGGGRRGPGSQAGQCAAGGGTVPGRQGCDCQRQQVQNAQVQDAIVRGVSPRQVHRGLGGCVCTQSGGRRESPLHAGGPQDH

SEQ ID NO: 1126 - protein, 85 aa, Homo sapiens
GPQAGPERPQGGSDSPRCEDVSVQHGGGRPGPESKAGWCAAGGGPVPGRQGGDCQRQQVQNAQVQDAIIWGVGPRQVHRGLGGCV

SEQ ID NO: 1127 - protein, 85 aa, Homo sapiens
GPQRGPERPQGGSDSPRCEDVSVQHGGGRPGPESKAGWCAAGGGPVPGRQGHDSQRQQVQNAQVQDAVIRGVGPRQVHRGLGGCV

SEQ ID NO: 1128 - protein, 17 aa, Homo sapiens
AYSPLLLTWRSRLAKWT

SEQ ID NO: 1129 - protein, 16 aa, Homo sapiens
GPQAGPERPQGGSDSP

SEQ ID NO: 1130 - protein, 13 aa, Homo sapiens
CEPPLHAGGPEDH

SEQ ID NO: 1131 - protein, 72 aa, Homo sapiens
LPKTAGSKFPSSRCRHSGCLPQASPSRPRWMCLRRRWRPTGASPPCRGTSRPLTSAFSPLPLTWRSRLAKWT

SEQ ID NO: 1132 - protein, 70 aa, Homo sapiens
AGWCAAGGRPVPGRQGHDCQRQQVQNAQIQDAVVRGIGPREVHRGLGGCACTQGGGRRESPLHAGGPEDH

SEQ ID NO: 1133 - protein, 68 aa, Homo sapiens
CEDVSVQHGGGRPGPESKAGWCAAGGGPVPGRQGCDCQRQQVQNAQVQDAIIRGVGPRQVHGGVRGCV

SEQ ID NO: 1134 - protein, 67 aa, Homo sapiens
CASAGGPDPGQQGPDYQRQQVQNAQVQDAVVWGVCPRQVHRGLGGCVSTQGGGRHESPLHAGGPQDH

SEQ ID NO: 1135 - protein, 67 aa, Homo sapiens
KTLKKGTNSDRKGSGHQRQQVQNAQVQDAIVRGVSPRQVHGGLGGCVCAEGGGRREPPLHAGGPQDH

SEQ ID NO: 1136 - protein, 67 aa, Homo sapiens
NGPQGPPARCQGPQAGPERPQGGSDSPRCGDVSVQHGGGRPGPESKAGWCAAGGGPVPGRQGCDSQR

SEQ ID NO: 1137 - protein, 160 aa, Homo sapiens
APLCPTGGPGWPGGREAPRGPRSRGSWPQRAPAQVADAQFQDAQSRSQGPPDRHQGPQAGPERPEDGCDGPRRGGVSAQHGGGRRGPRSQVGWCTAGGGPVPGRQGCDCQRQQVQNAQIQDAVVQGVCPRQVHPGLGGCVCAEGGGRREPPLHAGGPQDH

SEQ ID NO: 1138 - protein, 155 aa, Homo sapiens
PGGPGWPSGCETPRGPRAGGSRPQRAPAQAADAQFQDAQSRSQGPPDRCQGPQAGPERPQDGRDGPRRGGVSAQRGGGCRGPGSQAGWCVAGGGPVCGGQGCDYQRQQVQNSQVQDAVIRGVCPRQVHRGLGGCVCAEGGGRREPLLHAGGPQGH

SEQ ID NO: 1139 - protein, 147 aa, Homo sapiens
LEPPFCFGLSLGACASFCSPFRPGSLVGSSSCPAFSPSFSSSLGSHPGSCAPFSSDLGSRSRPHSGSGSHASIHASSGPCPSVCAHAHSNPIFRPTFYPHPHPRLCSYTGACTHPSPHLYSSPYTHACCHASCHSHLCTHPGLLQFE

SEQ ID NO: 1140 - protein, 51 aa, Homo sapiens
TKTPTWASTVTPAISPSRSPSPSLIKESLRALVPRVAKRAARLVLRDSQAQ

SEQ ID NO: 1141 - protein, 113 aa, Homo sapiens
SLQHRSTAACTTGPVLTGFACVASTRREEHLFLMRSQRQATASTLDLRSFVSAAVFPRWSSRQLEVAAMPGGQTQMAVLQKNLGTSQKTSLTIPSQKWTTLGTWQRLRASWCP

SEQ ID NO: 1142 - protein, 101 aa, Homo sapiens
SAAKRRTVKSSSSSHKPRPWSGVPTDPSAGSCPVTPRNPPRKAPGGLQIQEKSTMESGESTSTGSRQSRSPSLQENEPTATRKVPWKRKQRAVSVTLFLWF

SEQ ID NO: 1143 - protein, 74 aa, Homo sapiens
SWQETRSLRTKCWPPTCPMSWSWPPPRTCLRCLSCLCYLTTATPRNLYWTWFRAAGGAPAQSAHSLEARWIWGE

SEQ ID NO: 1144 - protein, 71 aa, Homo sapiens
PPVRGRPSGPPALFRSFLVCHLSAPAKPCTDFLRGNHGLGAPSFQSRTLLQRTKLAGLLPSLMKNKSILSS

SEQ ID NO: 1145 - protein, 69 aa, Homo sapiens
NDILQPALPLGCQGAKPRNSLCGNPRGRQIFIPGVQSMGNLPAPRSCLLAGPRTTRRLCFPLAFPVPGS

SEQ ID NO: 1146 - protein, 50 aa, Homo sapiens
PWGDWIQRGAGPPWRAWPARRAWKCAECGSVAGNCWHQGICPAGDRGDLG

SEQ ID NO: 1147 - protein, 49 aa, Homo sapiens
GCLGPEASVGSQASGVKMAAPARRDPEDSRGPLAAGESVGRRVMLGVQD

SEQ ID NO: 1148 - protein, 130 aa, Homo sapiens
TQDLEPERRESLGTADKRVLEGPRVILASLEPLGKGALKGFGDPQAHRGTQVSEAQQEKRVTGVPLGWMAGADWMGNQEPLGPLGRMVLQAKLGTQGETGFQASVENRASLAPLVPLDYRESQARMANLA

SEQ ID NO: 1149 - protein, 41 aa, Homo sapiens
RTWASWAERGPWTIGPPWTSWTTGGPRTPWPPRASWNSHEG

SEQ ID NO: 1150 - protein, 16 aa, Homo sapiens
LQGGQHSHRGCNSPCG

SEQ ID NO: 1151 - protein, 73 aa, Homo sapiens
RALQGCLALVGTRESEDLEAQRGSRGLPDKSSEVKDLGFLGGKGTLDHRAPLDLVDHWGTQDPVAPQGFLEQP

SEQ ID NO: 1152 - protein, 167 aa, Homo sapiens
LDLLELWDFLDPPALQALWVHRGLQVCLDKWGRQGSREPQVEMVPVEKMETEGALVCQGHQVCLALSDLKENLAPRGPLDRLWSGSLEQRERREPLEALLETWWVSREPKVTEDCQGREARRVKLAVQGSPETLGKMVRKGLQDPKVSRVTQESGSRAPLGLLALQV

SEQ ID NO: 1153 - protein, 163 aa, Homo sapiens [sequence omitted]

SEQ ID NO: 1154 - protein, 310 aa, Homo sapiens
RVTKAIVGSGVPLDQVKVALLLGSLGCRVFPEALDPKAPLAPLERKEKKVTLRMELQASQDNLGLRVSRAHGDLLELLAPKVTGAFQGPWVRLERRANVDPQAQRDPGGCQGLLDVLEPRVLKGHQDPLAAKERRGSLVALGTLQWWDLLLLDPKEKREMWGPLGPEELPESKGNGAHPAWFFLETLAPRETLETGVPLALLAEQDPQVTQGLLERRETLGGLAPQDLLAPEDEMVKLERKVTRVLRVTRVCLEKQASVAFGGHLEFGGLWVKRETREILERMDEMAALDHLDPRVTVGSRVPQDPRDGW

SEQ ID NO: 1155 - protein, 111 aa, Homo sapiens
STLQIKLTNVVTVARSLVAIQTLHNINESILERSLTNIMNVAKSSIRIHTLHNIRKFILDRNLTITKNVGKSLVTMPTLHSIGKFILERSLTNVVNVAKHLVCVPVLLLIL

SEQ ID NO: 1156 - protein, 88 aa, Homo sapiens
PLIRQFILERDHTNVMNVARGLVELHSLQGIGKFILERNLTNVMSVARSLLAIHALHDIGKFILGGGVTNVMNVAKHLERVQISLPIF

SEQ ID NO: 1157 - protein, 177 aa, Homo sapiens
PITVEFILERSLTNVTNVARSSVRIQTFNDIGKFILERSFTNVMNVARSSVRIHTLHNIGIFILERSLTVVMNVARSSVGIHTLCDIGMFILEKSLTVVMNVARSSVGIHTLRDIGIFILERSLTVVMNVARSSVGIHTLRDIGKFILERSFTNVMNVARSSVGIHALHNIGIFILE

SEQ ID NO: 1158 - protein, 52 aa, Homo sapiens
PLPSPSSVGGHPMDRVLLLVWGGHPEPGSFLCGGGHPGACHFSGRVEMHVHP

SEQ ID NO: 1159 - protein, 137 aa, Homo sapiens
KPASQRLSIPPCARPCLSLPPSGPVCWQPVQGPGGHPRSTARTSRPPGRSTYRLAGRGSCTSWWGASPTCSPRRRWCCAARRAGSASPSSPGRRTASTSSARRTSRWPPSAISRSTASSPRMQASTPAQRARPGSTL

SEQ ID NO: 1160 - protein, 26 aa, Homo sapiens
IPPKSPHSWKTSGPCSLPLDRTFLQC

SEQ ID NO: 1161 - protein, 83 aa, Homo sapiens
APRTAGQRPAVYTGESACGPCAQLPVATTASSPGVWSVCMPAPTRQCLSTCAPGGPGLPTGSAATSPHVKTWSAETPPGTARR

SEQ ID NO: 1162 - protein, 65 aa, Homo sapiens
LSRLINTCLASAAPCGPPPPGTPGEALEGHTASPPSCARSQRPSSSQPRRWSPTWGRRWPWPAGH

SEQ ID NO: 1163 - protein, 59 aa, Homo sapiens
KSSRISSKQNSISQPFIKHKLGSLKKNVKKRPNLVKNCSRRNRNYRMNGTLWLPNWRSP

SEQ ID NO: 1164 - protein, 38 aa, Homo sapiens
KDQILPFFGKKEILWPLPIAPGWFSFFMPFKMIGICTW

SEQ ID NO: 1165 - protein, 21 aa, Homo sapiens
KRYLKSPQLQTLLPDHLLELQ

SEQ ID NO: 1166 - protein, 21 aa, Homo sapiens
NDKKIRFCLFLGRKRYYGLCQ

SEQ ID NO: 1167 - protein, 16 aa, Homo sapiens
ENCEKNQRSTDEGRRL

SEQ ID NO: 1168 - protein, 56 aa, Homo sapiens
ISWLRMCAMTALLAPQASLVYQVLKGTKVSQESQGEKAQKGKRERLGLQAYQGPQE

SEQ ID NO: 1169 - protein, 133 aa, Homo sapiens
AQKAGMDLLVCKVSEGRKVTWDHLESLDCWGCRALQDPLVSQAPLDREVLRVCLERSASRESLDLLGPRDPLERTGQMDHQVRQEPRENQEKEGKMVCLENQAFGEKLGSRAWQADLERREKQASQGLQASQV

SEQ ID NO: 1170 - protein, 263 aa, Homo sapiens
LDHREVKENVVQMVRLGRKVIRVILEFQVSWGPQGTLGHQGQMELQELLDHQESKGHLGKKALLAPKAHLDYPESQEKKAKRAEMESRVPLESRAKQESQVYQDQRVPEAHLASRDTQAILVHPVPGESLVPWGFLVRKGYQEKMVTLDPLGHRVPKDQGAHRARMDHRDLQESLALQEPLARKEAKGKMAAQDFLASWVPVGLRENQERKESQARRGSLGSLESLDSKEKGEILGSKVTKDLLVEKASLGTLESQATKATQA

SEQ ID NO: 1171 - protein, 125 aa, Homo sapiens
SGSSWSSRFHGAPREPWATRGRWNCRSCWTTRNPRVTWERRPSWPPRPIWITRNPRRRRQRGQRWKAGSPWRAGQSRRARSTRTRGCPRPTWLQGTHRRFWCTRSPGRVWCHGASWSGRVTRKRW

SEQ ID NO: 1172 - protein, 105 aa, Homo sapiens
EGSQESWESRGCRVRSACGGPKDHLDSPDLLDVSELLVSKENEVKRELEEKRESEAWMDSLGSLGTQDSRAGPALLVWQDPREKRVTWDLRGHLVYQAQWCSKRA

SEQ ID NO: 1173 - protein, 168 aa, Homo sapiens
KVTEVKRVKLVLQALPGYLELHPCSHHIHGCPENKGPKERRAIQACLGNRDCRAVLENWGLRDPLDHRVPRDRKVHMGLLEQLETPVLPDMSVPPVPVALQEVWVLPASEAPQGKMGSVVRRVQRGKKAAQGQLVPGEILVLLGSLGHPEKGRMESRDSVDHLDSLDP

SEQ ID NO: 1174 - protein, 39 aa, Homo sapiens
FRENEGGRSCFAKRTRQQQSSSAPGEATSSGSTCPTFGI

SEQ ID NO: 1175 - protein, 109 aa, Homo sapiens
PSPRRAPTADNSERTKEEGAVSQKEQGSSSHPARLAKLPAQEAPVPPSAYEAAWSWRCGQMEARVYSIAPPGLEEGTGTKIPPNHCSKQGPQESIQGHLRHKVHQALSA

SEQ ID NO: 1176 - protein, 27 aa, Homo sapiens
PAISYSAKKQNKTLTAYGGRLCSGELA

SEQ ID NO: 1177 - protein, 92 aa, Homo sapiens
SSPPVSGWLGLMRKERTPGGQLQAFHRTIATGSPAGGMTQNPRPNVPPRKGALKSSEEEGALRLVLAALAVPGGRRSMLGRILPTIVHQETK

SEQ ID NO: 1178 - protein, 489 aa, Homo sapiens
HPQVTPPLFLSPALPQHLQVTPPLFLSPTLPQHPQVTPPLFLSPMLPHYPQDTPPLFMSPSLPQHPQVTPALFLSPALPQHPPVTPPLFLSPTLPQYPQVTPPLFLSPAFPQYPQVTPPLFLSPTLPRHPPVTPPLFLSPTLPQHPQVTPPLFLSPTLPRHPQVRPPLFLSPAFPQYQQVTPRLFLSPSLPQHPQVTPPLFLSATLPQHPQVRPPLFLSPAFPQYPQVTPPLFLSPTLPQYPQVTPPLFLSPTLPQHPQVTPPVFLSRTLPQHPQVRPPLFLSPAFPQYPQVTPPLFLSPTLPQYPQVTPPLFLSPSLPHHPQVTPPLFLSPALPQYLQVTSPLFMSPALPHHPQVRPPLFLSPALPQYLQVTSPLFMSPALPQHPQVTPPLFLSPALPQHPQVTPPLFLSPTLPQCPQVTPRLFLSPTLPQHPQVTPPLFLSPTLPQHPQVRPPLFLSPAFPQYPQVTPPLLLSAVLPQLPQYPRTPL

SEQ ID NO: 1179 - protein, 124 aa, Homo sapiens
AACVSASFRMWSQEFPSSPMGQAPGTWSSSGGPWTSPPHSSSRRLASPLAPLSVIPSTSQTMARSSSQSQTTRFSPTPTHSQQASQAGTLWPWWLRSGTMLTSPLVGGPHFIRNTRRSMVNTAC

SEQ ID NO: 1180 - protein, 2325 aa, Homo sapiens
PSVPQVPQVTPPLFLSPTLPQHPQVRPPLFLSPTLPQYPQVTPRLFLSLALPQHPQVTSLLFMSPALPQHPQVTPPLFLSPAFPQHPQVTPCLFLSLALPQHPQVTPPLFLSPTLPQYPQVTPPLFLSPALPQHLQVTPPLFLSPTLPQHPKVTPPLFLSPALPQHLQVTPPLFLSPTLPQHPQVTPPLFLSPALPQHPQVTPPLFLSPMLPHYPQVTPPLFMSPALPQHPQVTPPLFLSPALPQHPPVTPPLFLSPALPQHPPVTPPLFLSPTIPQYPQVTPPLFLSPAFPQLPQMTPPVFLSPTFPRHPQVRPPLFLSPAFPQYPQVTPRLFLSLALPQHPQVTPALFLSLTLPQHPQVRPPLFLSPTLPQYPQLTPPHFLSPAFLQLPQMTPPVFLSPTFPRHPQVRPSLFLSPALPQHPQVTPPLFLSPTLPQHPQVTPPLFLSPSLPQHLQVTPPLFLSPTLPQCPQVTPPLFLSPTLPQYPQVTPPLFLSPTLTQHPQVTPPLFMSPTLPQYPQVTPPLFLSPAFPQHPQVTPRLFLSLALPQHPQVTPPLFLSPTLPQHPQVTPPIFLSPAFPQLPQVTPPVFLSPTFPRHPQVMPPLFLSPALPQHPQVTPPLFLAPTLPQYPQVTPPLFLSPTLRQYPQVTPPVFLSPALPQHLQVTPPLFMSPMLPQYPQVTPPLFLSPTLPQHPQVRPPLFLSPTLPQYPQVTPRLFLSLALPQHPQVTSLLFMSPALPQHPQVTPPLFLSPAFPQHPQVTPPLFLSPTLPQYPQVTPPLFLSPALPQHLQVTPPLFLSPTLPQHPKVTPPLFLSPALPQHLQVTPPLFLSPTLPQHPQVTPPLFLSPMLPHYPQVTPPLFMSPALPQHPQVTPPLFLSPALPQHPPVTPPLFLSPALPQHPPVTPPLFLSPTIPQYPQVMPPLFLSPAFPQLPQMTPPVFLSPTCPRHPQVRPPLFLSPAFPQYPQVTPRLFLSLALPQHPQVTPALFLSLTLPQHPQVRPPLFLSPTLPQYPQLTPPHFLSPAFPQLPQMTPPVFLSPTFPRHPQVRPSLFLSPALPQHPQVTPPLFLSPTLPQHPQVTPPLFLSPSLPQHLQVTPPLFLSPTLPQCPQVTPPLFLSPTLPQYPQVTPPLFLSPTLTQHPQVTPPLFMSPTLPQYPQVTPPLFLSPAFPQHPQVTPRLFLSLALPQHPQVTPPLFLSPTLPQCPQVTPPLFLSPSLPQHPQVTPPLFLSPTLPQYPQVTPPLFLSPTLPQCPQVTPPLFLSPTLPQCPQVMPPLFRSPTLPQYLQDRPPLFLSPAFPQHHPLVTPRRFLSLILPQHPQVRTPLFLSPAFSQYPQVTPRLFLSLALPQHPQVTPPIFLSPTLPQYPQVTPPLFLSPTLPQYPQVTPPLFMSPMLPHYPQGTPPLFLSPALPQHPQVTPPLFLSPTLPQYPQVTPPLFLSLTLPQHPQVTPPLFLSPTLPQHPQVRPPLFLSPALPQHPQVTPSLFLSPTLPQHPQDRPPLFLSPAFPQHPQVTPPLFLSPMLPQCPQVTPPLFLSPAFPQYPQVTPPLFLSLALPQHPQVTPPLFMSPALPQHPQVTPPLFLSPAFPQHPQVTPRLFLSLALPQHPQVTPPLFMSPTLPQYPQVTPPLFLSPALPQHPQVTPPLFLSPTLPQHPQVTPPLFLSPTLPQHPQVTPPIFLSPAFPQLPQVTPPVFLSPTFPRHPQVMPPLFLSPALPQHPQVTPPLFLAPTLPQYPQVTPPLFLSPTLRQYPQVTPPVFLSPALPQHLQVTPPLYLSPTLPQHPQVTPPLFLSPMLPHYPHVTPPLFMSPALPQHPPVTPPLFLLPTLPQHPQVTPPLFLSPALPQHPQVTPPLFLSPTLPQHPQVTPPLFLSPTLPQYPQVTPPLFMSPALPQHPQVTPPLFLSPTLRQCPQVTPPLFLSPTLPQCPQVTPPLFLSPTLPQCPQVTLPLFLSPAFPQYPQVTPRLFLSPTLPQHPQVRPPLFLSPAFPQYPQVTPPLFLSPTLPQHPQVTPPLFLSPTLPQHPQVTPPLFLSPTLPQYPQVTPPLFMSPALPQHPPVTPPRFLSPTLPQHPQVTPPLFLSPAFPQYPQVTPRLFLSLALPQHPQVTPLLFLSPTLPQHPQVRPPLFLSPAFPQYPQVTPRLFLSLALPQHPPVMPPLFLSPTLPQHPQVTPPLFLSPTLPQHTQVTPPLFLSPTLPHHPQVTPPLFLSPRLPQHPQVTPPLCLSPTLPQYPQVTPPLFLSPAFPQLPQVTPPVFLSPTFPRHPQVRPPLFLSPTLPQYPQVTPCLFLSLALPQHPQVTPPLFLSPALPQHPPVTPPLFLSPALP

SEQ ID NO: 1181 - protein, 207 aa, Homo sapiens
PSLPQHPQVTPPLFLSPTLPQHPQVRPPLFLSPTLPQYPQVTPRLFLSLALPQHPQVTSLLFMSPALPQHPQVTPPLFLSPAFPQHPQVTPCLFLSLALPQHPQVTPPLFLSPTLPQYPQVTPPLFMSLMLPQHPQVRPPLFLSPAFPQYPQVTPRLFLSLALPQHPQVTPPLFLSPTLPQHPQDTPPLFLSPTLPQCPQITPPLFL

SEQ ID NO: 1182 - protein, 1559 aa, Homo sapiens
PSLPQHPQVTPPLFLSPTLPQHPQVRPPLFLSPTLPQYPQVTPRLFLSLALPQHPQVTSLLFMSPALPQHPQVTPPLFLSPAFPQHPQVTPCLFLSLALPQHPQVTPPLFLSPTLPQYPQVTPPLFLSPALPQHLQVTPPLFLSPTLPQHPKVTPPLFLSPALPQHLQVTPPLFLSPTLPQHPQVTPPLFLSPMLPHYPQVTPPLFMSPALPQHPQVTPPLFLSPALPQHPPVTPPLFLSPAFPQLPQMTPPVFLSPTFPRHPQVRPPLFLSPAFPQYPQVTPRLFLSLALPQHPQVTPALFLSLTLPQHPQVRPPLFLSPTLPQYPQLTPPHFLSPAFLQLPQMTPPVFLSPTFPRHPQVRPSLFLSPALPQHPQVTPPLFLSPTLPQHPQVTPPLFLSPSLPQHLQVTPPLFLSPTLPQCPQVTPPLFLSPTLPQYPQVTPPLFLSPTLTQHPQVTPPLFMSPTLPQYPQVTPPLFLSPAFPQHPQVTPRLFLSLALPQHPQVTPPLFLSPTLPQYPQVTPPLFLSPTLPQCPQVTPPLFLSPTLPQCPQVMPPLFRSPTLPQYLQDRPPLFLSPAFPQHPLVTPRRFLSPILPQHPQVRTPLFLSPAFPQYPQVTPRLFLSLTLPQHPQVTPPLFLSPTLPQYPQVTPPLFLSPTLPQYPQVTPPLFMTPMLPHYPQGTPPLFLSPALPQHPQVTPPLFLSPKLPQYPQVTPPLFLSPTLPQHPQVTPPLFLSPTLPQHPQVTPPLFLSPTLPQHPQVRPPLFLSPALPQHPQVTPSLFLSPTLPQHPQDRPPLFLSPAFPQHPQVTPPLFLSPTLPQCPQVTPPLFLSPAFPQYPQVTPLLFLSLALPQHPQVTPPLFMSPTLPQHPQVTPPLFLSPAFPQHPQVTPRLFLSLALPQHPQVTPPLFMSPTLPQYPQVTPPLFLSPALPQHPQVTPPLFLSPTLPQHPQVTPPLFLSPTLPQHPQVTPPIFLSPAFPQLPQVTPPVFLSPTFPRHPQVMPPLFLSPALPQHPQVTPPLFLAPTLPQYPQVTPPLFLSPTLRQYPQVTPPVFLSPALPQHLQVTPPLYLSPTLPQHPQVTPPLFLSPMLPHYPHVTPPLFMSPALPQHPQVTPPLFLSPTLPQHPQVTPPLFLSPALPQHPQVTPPLFLSPTLTQHPQVRPPLFLSPAFPQYPQVTPRLFLSLALPQHPQVTPLLFLSPTLPQHPQVRPPLFLSPAFPQYPQVTPRLFLSLALPQHPPVMPPLFLSPTLPQHPQVTPPLFLSPTLPQHTQVTPPLFLSPTLPHHPQVTPPLFLSPRLPQYPQVTPPLFLSPTLPQHPQVTPPLFLSPTLPQYPQVTPPLFMSPALPQHPQVTPPLFLSPTLRQCPQVTPPLFLSPTLPQCSQVMPPLFLSPSLPQHPQVTPPLFLSPTLPQCPQVTPPLFLSPTLPQCPQVMPPLFLSPTLPQCPQVTLPLFLSPAFPQYPQVTPRLFLSPTLPQHPQVRPPLFLSPAFPQYPQVTPPLFLSPTLPQHPQVTPPLFLSPTLPQHPQVTPPLFLTPTLPQHPQVTPPFFLSPTLPQHP

SEQ ID NO: 1183 - protein, 375 aa, Homo sapiens
AQEWRLRSSPAPFIPPSLRPPLQGDRQDSQAQLLPVPLLRRQPPFPGWPRLRGQEPAEGLTLSAWRPRQPTPSQQSHPHLHRSHPLGLHLHKPRPTLCHLQGLVKPSPRPSSATPPLFLSPTLPRHPQVTPPLFMSPMLPQYPQVTPPLFLSPALPQYPQVTPPLFLSPTLPQNPQVTSPLFLSPAFPQHPQVTAPLFLSLTLPQHPQVTSPLFLSPAFPQHPQVTPPLFLSLTLPQHPQVTPPLFLSPTLPQYPQVTPPLFLSPTLPQHPQVTPPLFLSPTLPQYPQVTPPLFMSLMLPQHPQVRPPLFLSPAFPQYPQVTPRLFLSLALPQHPQVTPPLFLSPTLPQHPQDTPPLFLSPTLPQCPQITPPLFL

SEQ ID NO: 1184 - protein, 1391 aa, Homo sapiens
AQEWRLRSSPAPFIPPSLRPPLQGDRQDSQAQLLPVPLLRRQPPFPGWPRLRGQEPAEGLTLSAWRPRQPTPSQQSHPHLHRSHPVGLHLHKPRPTLCHLQGLVKPSPRPSSATPPLFLSPTLPRHPQVTPPLFMSPMLPQYPQVTPPLFLSPTLPQNPQVTPPLFLSPALPQYPQVTPPLFLSPTLPQNPQVMSPLFLSPAFPQHPQVTAPLFLSLTLPQHPQVTSPLFLSPAFPQHPQVTPPLFLSLTLPQHPQVTPPLFLSPTLPQYPQVTPPLFLSPTLPQHPQVTPPLFLSPTLPQYPQLTPPHFLSPAFLQLPQMTPPVFLSPTFPRHPQVRPSLFLSPALPQHPQVTPPLFLSPTLPQHPQVTPPLFLSPSLPQHLQVTPPLFLSPTLPQCPQVTPPLFLSPTLPQYPQVTPPLFLSPTLTQHPQVTPPLFMSPTLPQYPQVTPPLFLSPAFPQHPQVTPRLFLSLALPQHPQVTPPLFLSPTLPQYPQVTPPLFLSPTLPQCPQVTPPLFLSPTLPQCPQVMPPLFRSPTLPQYLQDRPPLFLSPAFPQHPLVTPRRFLSPILPQHPQVRTPLFLSPAFPQYPQVTPRLFLSLALPQHPQVTPPLFLSPTLPQYPQVTPPLFLSPTLPQYPQVTPPLFMSPMLPHYPQGTPPLFLSPALPQHPQVTPPLFLSPTLPQHPQVTPPLFLSPTLPQHPQVTPPLFLSPTLPQHPQVRPPLFLSPALPQHPQVTPSLFLSPTLPQHPQDRPPLFLSPAFPQHPQVTPPLFLSPTLPQCPQVTPPLFLSPAFPQYPQVTPPLFLSPALPQHPQVTPPLFLSPTLPQYPQVTPPLFLSPALPQHPQVTPPLFLSPALPQHPQVTPPLFLSPTLPQHPQVTPPLFLSPTLPQHPQVTPPIFLSPAFPQLPQVTPPVFLSPTFPRHPQVMPPLFLSPALPQHPQVTPPLFLAPTLPQYPQVTPPLFLSPTLRQYPQVTPPVFLSPALPQHLQVTPPLYLSPTLPQHPQVTPPLFLSPMLPHYPHVTPPLFMSPALPQHPQVTPPLFLSPTLPQYPQVMPPLFMSPALPQHPQVTPPLFLSPTLTQHPQVRPPLFLSPTLPQHPQVTPPLFLSPTLPQHPQVTPPLFLSPTLPQYPQVTPPLFMSPALPQHPQVTPPLFLSPTLRQCPQVTPPLFLSPTLPQCSQVTPPRFLSPSLPQHPQVTPPLFLSPTLPQCPQVTPPLFLSPTLPQCPQVTPPLFLSPTLPQCPQVTLPLFLSPTLPQYPQVTPPLFLSPAFPQYPQVTPRLFLSPTLPQHPQVRPPLFLSPAFPQYPQVTPPLFLSPTLPQHPQVTPPLFLSPTLPQHPQVTPPLFLTPTLPQHPQVTPPLFLSPTLPQHPQVTPPFFLSPTLPQHP

SEQ ID NO: 1185 - protein, 1254 aa, Homo sapiens
VTPPLFLSPTLPQYPQVTPPLFMSPALPQHPPVTPPRFLSPTLPQHPQVTPTLFMSPALPQHPPVTPPRFLSPTLPQHPQVTPPLFLSPAFPQYPQVTPRLFLSLALPQHPQVTPPLFLSPTLPQHPQVRPPLFLSPALPQHPQVTPPLFLSPTLPQHPQVRPPLFLSPAFPQYPQVTPRLFLSLALPQHPQVTPLLFLSPTLPQHPQVRPPLFLSPAFPQYPQVTPRLFLSLALPQHPPVMPPLFLSPTLPQHPQVTPPLFLSPTLPQHTQVTPPLFLSPTLPHHPQVTPPLFLSPRLPQYPQVTPLLFLSPTLPQHPQVTPPLFMSPALPQHPQVTPPLCLSPTLPQYPQVTPPLFLSPAFPQLPQVTPPVFLSPTFPRHPQVRPPLFLSPTLPQYPQVTPCLFLSLALPQHPQVTPPLFLSPALPQHPPVTPPLFLSPALPQHLQVTPPLFLSPTLPQHPQVTPPLFLSPALPQHLQVTPPLFMSPSLPQHPQVTPALFLSPALPQHPPVTPPLFLSPTLPQYPPVTPRLFLSPAFPQYPQVTPPLFLSPTLPRHPQVRPPLFLSPAFPQYPQVTPPLFLSPTLPQYPQVTPPLFLSPTLPQHPQVTPPVFLSRTLPQHPQVRPPLFLSPAFPQYPQVTPPLFLSPTLPQYPQVTPPLFLSPTLPQHPQVTPPVFLSRTLPQHPQVRPPLFLSPSLPHHPQVTPPLFLSPALPQYLQVTSPLFMSPALPQHPQVTSPLFLSPALPQHPQVTPPLFLSPTLPQCPQVTPRLFLSPTLPQHPQVTPPLFLSPTLPQHPQVRPPLFLSPAFPQYPQVTPPLFLSPTLPQHPQVTPPLFLSPSLPQYPQVTPCLFLSLALPQHPQVTPPLFLLPAFPQLPQVTPPLFLSPTLPQHPHVTPPLFLSPTLPQLPQMTPPVFLSPTFPRHPQDMPPLFLSPALPQHPQVTPPLFLSPTLPQYPQVTPPLFLSPAVPQHPQVTPPPFLSPTLPQYPQVTPPLFLSPALPQYLQVTPPLFLSPALPQHPQVTPPLFLSPALPQHPQVTPPLFLSPMLPHYPQVTPPLFMSPALPQHPEVTPALFLSPMLPQHPPVTPPLFLSPAFPQYPQVTPRLFLSPTLPLHPQVRPPLFLSPAFPQYPQVTPRLFLSPSLPQHPQVTPPLFLSPTLPQCPQVTAPLFLSPALPQHPQVTPPLFLSPTLPQHPQVTPPLFLSPTLPQHPQVTPPLFLSPAFPQYPQVTPPLLLSAVLPQLPQYPRTPL

SEQ ID NO: 1186 - protein, 1191 aa, Homo sapiens
VTPPLFLSPTLPQYPQVTPPLFMSPALPQHPPVTPPRFLSPTLPQHPQVTPTLFMSPALPQHPPVTPPRFLSPTLPQHPQVTPPLFLSPAFPQYPQVTPRLFLSLALPQHPQVTPPLFLSPTLPQHPQVRPPLFLSPALPQHPQVTPPLFLLPTLPQHPQVRPPLFLSPAFPQYPQVTPRLFLSLALPQHPQVTPLLFLSPTLPQHPQVRPPLFLSPTLPQHTQVTPPLFLSPTLPHHPQVTPPLFLSPRLPQHPQVTPPLFMSPALPQHPQVTPPLCLSPTLPQYPQVTPPLFLSPAFPQLPQVTPPVFLSPTFPRHPQVRPPLFLSPTLPQHPQVTPPLFLSPAFPQLPQVTPPVFLSPTFPRHPQVRPPLFLSPTLPQYPQVTPCLFLSLALPQHPQVTPPLFLSPALPQHPPVTPPLFLSPALPQHLQVTPPLFLSPTLPQHPQVTPPLFLSPALPQHLQVTPPLFMSPSLPQHPQVTPALFLSPALPQHPPVTPPLFLSPTLPQYPQVTPPLFLSPAFPQYPQVTPRLFLSPTLPQYPQVTPPLFLSPAFPQYPQVTPPLFLSPTLPRHPPVTPPLFLSPTLPQYPQVTPPLFLSPAFPQYPQVTPRLFLSPTLPQYPQVTPPLFLSPAFPQYPQVTPPLFLSPTLPRHPPVTPPLFLSPTLPQYPPVTPRLFLSPAFPQYPQVTPPLFLSPTLPRHPQVRPPLFLSPAFPQYQQVTPRLFLSPSLPQHPQVTPPLFLSPTLPQHPQVRPPLFLSPAFPQYPQVTPPLFLSPTLPQYPQVTPPLFLSPTLPQHPQVTPPVFLSQTLPQHPQVRPPLFLSPAFPQYPQVTPPLFLSPTLPQYPEVTPPLFLSPSLPHHPQVTPPLFLSPALPQYLQVTSPLFLSPALPQHPQVTPPLFLSPTLPQYPQVTPPLFLSPTLPQYPQVTPPLFLSPTLPQCPQVTPRLFLSPTLPQHPQVTPPLFLSPTLPQHPQVRPPLFLSPAFPQYPQVTPCLFLSLALPQHPQVTPPLFLLPAFPQLPQVTPPLFLSLTLPQHPQVTSPLFLSPAFPQHPQVTAPLFLSLTLPQHPQVTSPLFLSPAFPQHPQVTPPLFLSLTLPQHPQVTPPLFMSLMLPQHPQVRPPFFLSPAFPQYPQVTPRLFLSLALPQHPQVTPPLFLSPTLPQHPQDTPPLFLSRTLPQCPQVTPPLFL

SEQ ID NO: 1187 - protein, 155 aa, Homo sapiens
RQTVGDAQPHHHPPQPPRPSFPPFPALPCTPAPQLPPSPSCLREEFPSSPMGQAPGTWSSSGGPWTSPPHSSSRRLASPLAPLSVIPSTSQTMARSSSQSQTTRFSPTPTHSQQASQAGTLWPWWLRSGTMLTSPLVGGPHFIRNTRRSMVNTAC

SEQ ID NO: 1188 - protein, 155 aa, Homo sapiens
RQTVGDAQPHHHPPQPPRPSFPPFPALPCTPAPQLPPSPSCLREEFPSSPMGQTPGTWSSSGGPWTSPPHSSSRRLASPLAPLSVIPSTSQTMARSSSQSQTTRFSPTPTHSQQASQAGTLWPWWLRSGTMLTSPLVGGPHFIRNTRRSMVNTAC

SEQ ID NO: 1189 - protein, 54 aa, Homo sapiens
TPSRALRGSLAWRSGPLGEKPMSPWRGTLRSPLGGLIRPHRQHPALFCSVRPLP

SEQ ID NO: 1190 - protein, 137 aa, Homo sapiens
WDLQYLLQKDYSRGLLQPQHQPPSFLSPAFQVRSLAARPEPLPAFLPQSWKRRPCWLPVSSCTDSWGQDGDEQVQKSRLRVFWDSRKQGLLHTVFHRVQRKQTFCCCLRESQSHSVQVPEHHSVPGEGMRHPWKHHV

SEQ ID NO: 1191 - protein, 118 aa, Homo sapiens
DRASAEMCLEPHKAPQGPSAPGPPARTSWPAAARSSAWSVSIPTRGWALGPTGVSLPPKTPPSSVAGPPPVIILAMPSATATATNAFSSSRCMANRKQVGHLLQEVGPRAVSHHGAIL

SEQ ID NO: 1192 - protein, 35 aa, Homo sapiens
VQEMAGKQRAGEERGARPESHGTFRAPAFSHGCKM

SEQ ID NO: 1193 - protein, 26 aa, Homo sapiens
KRTVTAIASCMPLLSTCGAFRTQTWY

SEQ ID NO: 1194 - protein, 20 aa, Homo sapiens
GVHWGASFGPTDSTQPFSVQ

SEQ ID NO: 1195 - protein, 60 aa, Homo sapiens
NTQLCIAIIALQTNPLSIPWNSRHFKEAVDYHLVQTPALTWGVSNWRVKSLPCLPFFSVL

SEQ ID NO: 1196 - protein, 48 aa, Homo sapiens
DAGQNGNGLQTGQLLSAAGTGFRLMFLTWNIEFVSKQTFTNRYVLIRG

SEQ ID NO: 1197 - protein, 45 aa, Homo sapiens
NLSGRTSLLTKSNLPKSYRLSTEHPCRAVCQIQLVRTGTNWSAPS

SEQ ID NO: 1198 - protein, 39 aa, Homo sapiens
LKVQHILIMTIPLPSMGENGLSLHLLFMGVKWEDLNLGT

SEQ ID NO: 1199 - protein, 98 aa, Homo sapiens
PVRIPVVPHQSWGWMNSLSSPGSGGPSPWRTVPRRSVRTSWMHRSEQPAALDAPQAARLAGRQRQRPPRLPLSPSRVGIWWQQPQLSARLTDERETAI

SEQ ID NO: 1200 - protein, 65 aa, Homo sapiens
LSLFLSHWKTMVPLLLVIFQSHCLPNHVEHSDLSMELLTLFSLSWQTTFQVTALMLRNNYIRSND

SEQ ID NO: 1201 - protein, 56 aa, Homo sapiens
TLGNAAGASSRMKPSCGSAPSRRPSSKAGSTKKGGAPPRCPGEIGRSAGLSSASPS

SEQ ID NO: 1202 - protein, 55 aa, Homo sapiens
NRSSDPQAGNDIHGLLPWRRLLQDHHQLPHHRWGGGGEADPRPGHGGQQEHVCFV

SEQ ID NO: 1203 - protein, 47 aa, Homo sapiens
NLLVVPLQAGGPQARLAPQKRGGLLHAVQEKLEEALVCPPPVQADVL

SEQ ID NO: 1204 - protein, 161 aa, Homo sapiens
CLQQRVAAGEDQGLSSRILGTETGEAEGRGSEPRGHGDSGPCLGLLSTKTIQKGPLLCGDNTEELQSIPSEEEIFAPEKGSHSFPEATQRSDCSESLQTIAGREKGARRKEETGRGRKEETGGRRKRKRERAKRSRAPRPAGRRNEEAARTRSLAEEPEGS

SEQ ID NO: 1205 - protein, 33 aa, Homo sapiens
IKKKETFKKKTYTCAITTVKATETKAGKWSRWE

SEQ ID NO: 1206 - protein, 136 aa, Homo sapiens
TTSAGKSLSPSSGWTSSTWSGRSTRSSFDSVRRRSPSHPPTAMSGVPGTHMPGTSRSQLGSGPMCPHGVTGFCGNPTLKLTSSAILMVALMTSSPATIPPCLGHLRLELPPSSSPRKGSQRLQTRPTLSLRASRPL

SEQ ID NO: 1207 - protein, 41 aa, Homo sapiens
GVWRHTAPSRLSTSTTAGLSHLPAPQPGSFTRASGPGPWWG

SEQ ID NO: 1208 - protein, 86 aa, Homo sapiens
RCGCPRSAWAPVSGSTSGSALIRMRQEQRAKPPLCPEGARSPGQGAASQPSQRPPARSPGYLKNQRNRHQRGGPQPHPEQLPGRSP

SEQ ID NO: 1209 - protein, 168 aa, Homo sapiens
SQRELLNQKGWRPPHPRTASITLPTTSLKGSRTSCCPRSHPRLPGPLSHLPPRTKWPLQCLLHSLGTTGTLVWERGVLQMRSLEAHCPLQTFHLHHCRTQPSSCPPAWILYQGQWSGAVVGLRPVAHHLPRPIQGLHCPQAPHQPALSWGKWPVGMTGPARCCRWPRR

SEQ ID NO: 1210 - protein, 69 aa, Homo sapiens
PYPMTSMSLGPRRTQWATASGWTYCAGASRSLRIWITARLPCNHCGISRWQCWSSQSTRTVSAMSVRPV

SEQ ID NO: 1211 - protein, 124 aa, Homo sapiens
RRTSALWRTSWKIGVVVVANSVTFVEGNIRLQSSCWSVISAETAITLSAWDQTTPPNPQRRRKSGSVPSVFAVRAVDPQLQAKGGMHSGLMISHCVMIAPSSLLKETSALSVTNVMMMMTMRVR

SEQ ID NO: 1212 - protein, 122 aa, Homo sapiens
SLHRIVDSVPRPVDLLKNQVQLLSTPLKCLQTPLDLVAPVLIPPQTLRLLRRFRYFLRSGAIPLKFILHCPFPSPQKMRVMIGEAEGIQCRREVLDLERRKNYQLYKVPPSSRPPRLHLHLC

SEQ ID NO: 1213 - protein, 120 aa, Homo sapiens
RTWWTLVRNLPHQQERILPQRKAVVSLLHESPSRKRVKKGMSRPLGLNPNRPPLQLPGSQASRSPSQHWSSRLSHLLQDRQEKKFPKPLLVSPRKSSLHHQNQVQSRANRKKWLPAQVSL

SEQ ID NO: 1214 - protein, 31 aa, Homo sapiens
KRLLRRQLVSTGLPSMAGVFSVRETLMQVRW

SEQ ID NO: 1215 - protein, 53 aa, Homo sapiens
RWPRPSSATARPSRSCSSASPSSSRPCSGARPSCTGTRARAWTRWSSPRPRAT

SEQ ID NO: 1216 - protein, 28 aa, Homo sapiens
PTRWGVARGPEWARCSSVRSARSSQTAS

SEQ ID NO: 1217 - protein, 218 aa, Homo sapiens
DLLHRQRGTLRHLFPHPQADHPHLRGPQPPGVGHHERGHHLPALPGPAERRPAQAGRQHGSLSSPALLHARLRTPDQPGQPAVPGPDGARAHPADVRCQEHDGGVRPAPRPLPDRGRRVPGPHVHEGGGRADAERAEQEQQLLRGVDPQQREDGRVRHPAPRPEDGRDLHRQQHGHPGAVQAHLRAVHGHVPAQGLLALVHGRGHGRDGVHRGREQHE

SEQ ID NO: 1218 - protein, 35 aa, Homo sapiens
CLWSTTTANPPSASNTCRQWSMHKCPITSPHREIG

SEQ ID NO: 1219 - protein, 218 aa, Homo sapiens
AGRRGHVSLRIASTSSHFRSHHSPFSIEGTESRCEKYHLSRSRSPESPPCRFIHRRSLPGLVFQSPSLVLTEQEPELLQTSKQKPNWSKHRGQQLPLPPQLLQPPQLEGPFQDLAQGVDKVQERVVKGRLLEEAVQAQTESVKLERAPHWNWQELEAGEVRESFYPVVQRLSPSLRPRPPQARHSLIVSLEHNYSKPPQCLQHLPSVEHAQVSHHQPT

SEQ ID NO: 1220 - protein, 24 aa, Homo sapiens
EEGQDLGGGRQDGLRKIPQYTHES

SEQ ID NO: 1221 - protein, 57 aa, Homo sapiens
DDGTEDEGRTGEKEEKGDGRENVIRGDQGTNSEVGGEAFGSTGREAPAFPAAQESFT

SEQ ID NO: 1222 - protein, 56 aa, Homo sapiens
QSQTNVWTPSAYDPALRGLSSCFCRDTRAWTIPRQSWWCLWDCSAPTSLWAHTASL

SEQ ID NO: 1223 - protein, 223 aa, Homo sapiens
LFTQELISSACRGALEDTIAQAPSWQLTEPNKCLDPKCLRPGTTWAQQLLLQGHQSMDNSKAVLVVPMGLLSPHLTMGPHSQLIVLVSSSELLRHSLQCSTYLSHSHSPMLCMATFSPLRQVSSSLVVPCPCKSRWNMLTSRLASPTHPLCAPCTPRLCIQPLDSLLPPSSLCRCSQQESRALQLPANLALGSPSSNTARTRDSTTSDHQIISSTPHPPPHRG

SEQ ID NO: 1224 - protein, 35 aa, Homo sapiens
AGRLYRPLPPTLQTHEGADPRLGQGQRRGHRHPLH

SEQ ID NO: 1225 - protein, 22 aa, Homo sapiens
TRAWGRVCPSGPGSCWAWLWRS

SEQ ID NO: 1226 - protein, 87 aa, Homo sapiens
RWQTRRTAHPASHLSSSTTRSTVATPQLETCWRPSSCCRLDQQGRLTCPPSMARWTWTEVPSCPCPWASGPCSASTEWRCCSGAYGT

SEQ ID NO: 1227 - protein, 66 aa, Homo sapiens
TSVWWTAGPSVATHWWAPMPSAPCDASSTGPQTARPPAGTPRSGFSGAAVCCAMGAPPLTPQGRLW

SEQ ID NO: 1228 - protein, 58 aa, Homo sapiens
PPAPTCHPHESQHPHVPWCASCPHKPVCRRVCHHLPPCLPQRLQPRLQLCRGCQLLHC

SEQ ID NO: 1229 - protein, 95 aa, Homo sapiens
PVSGLVPWAVCVSASPPQLSEAQSHLIPTAGLVGMGHQIPVSTVYALKAPAPGDHPGTAGSPAETACAAARGRGPAVPHREGHQLARPRQAGSGL

SEQ ID NO: 1230 - protein, 73 aa, Homo sapiens
TTCLAPCTRLGMSRVFWNRWRPTRLRLVRPWPHCPPVQGYCSPCWRGGGSWGWRCLRPSSSSGRWNRRDGWMR

SEQ ID NO: 1231 - protein, 65 aa, Homo sapiens
SQRGYGAQGQRLRRSRRRKSWRRRLGVRAPLHPSPPLAAPAPRRTRMAWNRRKGPLQAPRPLSPL

SEQ ID NO: 1232 - protein, 127 aa, Homo sapiens
WSLAVPPPVRRHAAFENVSSTSRSITFKRCSKILLCSCALLDLRDPWHSSGNTLRGWRRRRQNRFRICRKQALVQTQGRMRFLLLHPTQWLKVGGDEVLSALRSTRRKMRHPMLERLYQKITRQWPL

SEQ ID NO: 1233 - protein, 94 aa, Homo sapiens
SALSWTDLDLNVFLAHAQTSSNETSSSTTVLCHCLSEICLLCLPFLLSPIHASLMQTALFSLLAAPSGHWHRSFLSVYILKVAFIAPFSIWSIN

SEQ ID NO: 1234 - protein, 242 aa, Homo sapiens
INPMYALSVGRLSSRSLASSIIREFTLGRNLMDAVYVGKPSPESPGSLNTRETTQERNPMNALNVTKHSAGNHSSMHTRKFIQERSHIYAVIVEKASSRSLGSLIIREFIQERNHMDAACVGRPSPKGPGSLNTRELIQERNPMNALNVTKHSAGNHSSMHIRKLTQERSHIYAVIVEKASFRREISLYISEFILEKNPIYAMNVEKASSKRATSLFIDVLTLERNPMYAMNVGKASARRHV

SEQ ID NO: 1235 - protein, 97 aa, Homo sapiens
YPIRDFTQERHPLYVLSVENPAHTSQVSLTTREFTQERNPIHAVTVGKLSEINHVSTDIGELIQGRDRMDALIVGKLSPTCHALFIIRECCMQERNV

SEQ ID NO: 1236 - protein, 41 aa, Homo sapiens
HEGSGWAWLSSIVSFMPWGALTGQTALIQLSVTTQRGTSGE

SEQ ID NO: 1237 - protein, 88 aa, Homo sapiens
TSCGSASSCVTSHCRSSTRMHRPPSSWPTRWCWPHPALSSRPCSPTGCGSRAWRWCPLRVSTPRSWSASLNSPTRPPSPWARSVSSTS

SEQ ID NO: 1238 - protein, 73 aa, Homo sapiens
HRAGVGWAWLSPWSPAGSRLTSRTVPVEALLFLGQKYSPMGSIIVFVQKPGLKEKTALQITHLPGREARMPQC

SEQ ID NO: 1239 - protein, 60 aa, Homo sapiens
RRNTLSRVALVFIVRLDSLTPGLPGVRVTRVAINPSVVRFVTTLPLPKATSVFICSRTST

SEQ ID NO: 1240 - protein, 148 aa, Homo sapiens
QALSNFSIFSRNAAPATSSSSLASGSSTAFFYGSCKDPQHGFYSSASSTTHSSPTTTTSSSSSSSPPTSSTFCSSTGPTAGFSGPAALSFHYDATCATPCASSPACPAAATDGRTLCRPHPTLPAAARIRSQLLKTFSVQTPTDKNYR

SEQ ID NO: 1241 - protein, 56 aa, Homo sapiens
RSPTRFLLLCKLHHPLLPHHHHLLLLLLLPPHLLHLLLLHRSNCRFLWTCRSFLPL

SEQ ID NO: 1242 - protein, 48 aa, Homo sapiens
MPLLLRLGMIKIKPILMRLHRLIRQSVTPPPETRETLKWKAPQEVPEM

SEQ ID NO: 1243 - protein, 45 aa, Homo sapiens
KKGSCKSGSRIHERGRGKASSGRWVQHSLINGVRFAEPCLKQSRP

SEQ ID NO: 1244 - protein, 39 aa, Homo sapiens
AKQGEKNQRGGIRGHQTRKTPQKRGKNLICSFSVGQSCR

SEQ ID NO: 1245 - protein, 36 aa, Homo sapiens
PVMAQPKTPVCPKMSLTMWTCPNSMVVLAMGKGNLF

SEQ ID NO: 1246 - protein, 25 aa, Homo sapiens
RPPNPKNTPKKRKKSHLLFQCWAKL

SEQ ID NO: 1247 - protein, 93 aa, Homo sapiens
ADSSCHTLSLGLLLILHLSSLEQCRGDTSHLSVAWRASFLMALQCPRHWQVCPQVHCCSSTNSISRTCRSPCKSSKSNSKNSSRNQFRQRHPK

SEQ ID NO: 1248 - protein, 20 aa, Homo sapiens
AFWNQKNPLLFIPIFLLQTS

SEQ ID NO: 1249 - protein, 70 aa, Homo sapiens
NRLCLPKSQKLWILCQNLQPHLPRRSAMTNFSFLSQAHPSISMTKMATTTKAFTSQMTRMTTPTAAKRPA

SEQ ID NO: 1250 - protein, 63 aa, Homo sapiens
LRIRKSSVTRMKMMMPKMKAKQKTPWMPLIKWYTSIAQCLAKRMQLKTLLPLQQVLALGPAPP

SEQ ID NO: 1251 - protein, 61 aa, Homo sapiens
MNSKKGNRSLFLTVMSTSIAVTIVAWLSKLCRSFRYIPSIMQFGLRQCVTSASAVSVHSRL

SEQ ID NO: 1252 - protein, 52 aa, Homo sapiens
MSSWRGSLPCGNQSSGPGPSPSSSPPRRALSSPLPSTPTSPHTRATCALPCA

SEQ ID NO: 1253 - protein, 39 aa, Homo sapiens
TSRPSPRLRTSGSVASSGARNQLPRSSPLPCSPPSSPSE

SEQ ID NO: 1254 - protein, 108 aa, Homo sapiens
GTEAGESGGPTAGPLCATNDATEGAAGGRAAPGTPEFFPRSQETPKPVTAPATLPAGIRPPGEPAGLPAGPTAPKPGGCLPSTEAAAAAATTAAAAAAAGSPTPDAAL

SEQ ID NO: 1255 - protein, 78 aa, Homo sapiens
ELLFHAAATLAATPGLWPAASWATGTVPPGSPQHGTLPLPPQPRYEPRTAQGPSAGLSPAASATSGPDPLPPPLPPPL

SEQ ID NO: 1256 - protein, 75 aa, Homo sapiens
PPSEHEKTVGWYPSSSQCLCLCELWTQLRQPRLEVLMRTGRVLNRTLLSTSHQSSSPAGGPPESPGQMLKLRQRT

SEQ ID NO: 1257 - protein, 62 aa, Homo sapiens
LTTPLSGALSYLPTRRPPSSALCGKALASTSMPSYQPAPSLPLLPSRLRVPIARCSGLTVLK

SEQ ID NO: 1258 - protein, 156 aa, Homo sapiens
RSPGRRGRRRCQRSKRRRSRKRGESAAGGQRQSKPRRHYRPMSRPVTSSSSGATSPTPLGLPVARPRRSQGKGQGSHEGHYLFQRRRKKQRHSVRPRIRRTLSPVKNVAGKVGSAVPAGTPAGWCAEGAGVGWRGGGRGTGGVRLVSGWLSGFLGL

SEQ ID NO: 1259 - protein, 52 aa, Homo sapiens
LFSRSQSPSASTSVQWRAPHTGRESRWPISGAAGAPGALLTNSQRYPAHAFS

SEQ ID NO: 1260 - protein, 44 aa, Homo sapiens
VPPCFGVCCCFTCPPQVSITSCPVTWMDLFSKTSPSESWDPSKP

SEQ ID NO: 1261 - protein, 114 aa, Homo sapiens
NYAQVAQTCCLLSRRWCHCHLVSTPSRSMAWAPDHSFPCLRVQAATVACGISENQLGPTRGLTAGSVICHHYLSTLPVTPPASTQLLQFSAAWGGSPWIYLWQAARCIPQALTL

SEQ ID NO: 1262 - protein, 101 aa, Homo sapiens
SLPRCTKSSHQCWARPRGTSSPPRLHRSWQACWRAQLLLLPLSPPLFWGLLLLHLSTSSLHHFLPRHLDGPLLQNLPFRVLGSLQTIKHPSPWPPQPCWEM

SEQ ID NO: 1263 - protein, 15 aa, Homo sapiens
SQVAPHLLQPASLPL

SEQ ID NO: 1264 - protein, 80 aa, Homo sapiens
PLSPRGAIALQQIPKPLRLHQCPVASPPHWERIPMAYLRSSWSTGSAPYKLSEISSACFFLMRKNSQEHKVGDRSRILGY

SEQ ID NO: 1265 - protein, 162 aa, Homo sapiens
CHTILSWGMGPRSHRWYLKDGWASPRASLQYSLPHSRFHSLTMAPVGGRAASQEGWVSQEKAPLAAPATCPKVQQMQHFASLEAPGVLTPSLSWGTACLRCLQTQICRRSSDLEPPEYLSLIYPALFHLRSPARRCNISLEGKFQAVNSPRVLDLGFHTCRG

SEQ ID NO: 1266 - protein, 57 aa, Homo sapiens
THLKTSSTSSSSTCYSCSSSPWWLCSSSRGNSSTALTSPKSLRKIVEANTSSTRRMR

SEQ ID NO: 1267 - protein, 56 aa, Homo sapiens
DCQETRPHHSGHPPSLPTPPQPHRRTSEQKRQPRPTAKKRGREEGGGGRRPWGRRP

SEQ ID NO: 1268 - protein, 54 aa, Homo sapiens
ISLSPSSWTTLSTSPETPPSWAPTTWMSTCVSGPSMTPQLAVGFIIRICTVYYE

SEQ ID NO: 1269 - protein, 54 aa, Homo sapiens
TKTPTQTHCQKKRKRRRRRRKTTVGKTALSQCLPIAPCSSCPRPTPFAACAITS

SEQ ID NO: 1270 - protein, 46 aa, Homo sapiens
SPSSACCFSFSCSLSSSPFWECNSSAASLISMKGLLPPTSILFQQQ

SEQ ID NO: 1271 - protein, 44 aa, Homo sapiens
PLPSLAIAKEKTSTRLNPSESSGCYDLLKPSSGCQSSRLCLTVW

SEQ ID NO: 1272 - protein, 116 aa, Homo sapiens
RTTSWPPRSRPLPTAALATPACPRAQPRWETAPTPAPCWPSLPWPPTPRTPPAAGRPTTRGTHPIPAPPRPPRIALSSPTPAAPRPIQLRLPGNPTTPQWTSPQPAHPPSTTPSYK

SEQ ID NO: 1273 - protein, 31 aa, Homo sapiens
RAKTGTRSCTTGSSLRGACRAAWCSPSISLY

SEQ ID NO: 1274 - protein, 89 aa, Homo sapiens
PSVPRRCSRRRAHGVRNKAPLPTCPTASLTLSPWRCERWAEMATPTASTTSPWKARAGLPPCPASLQRTRGEGAGHVGITSVPSQTPAP

SEQ ID NO: 1275 - protein, 176 aa, Homo sapiens
AGRDPTAASRTTTPGRAAWSNPGSGRARPSEARPGTPTGGTCTGRGAAGRAAAGPRARARTGSIDVIARTAGPGRRVRRTRRSGGRGTARAAGRPGAARARARAPTGASAGEGTGMALQPRTRGTRGGRTRSGGIGGGKRTRAPGSLCRAPTCQPPGQSSRTWAAKTHPWQRILTT

SEQ ID NO: 1276 - protein, 50 aa, Homo sapiens
LLCLNTSSLPMILTAVWKSRRRWSNAWAPSRMGWLRSVLIIFRDSDVLPT

SEQ ID NO: 1277 - protein, 45 aa, Homo sapiens
KRQKLHCRPSGLRTSPLFARWAAPLTSSCGSWIAYCCCFKGKSVL

SEQ ID NO: 1278 - protein, 45 aa, Homo sapiens
SFCGQDLWCDWGRPLLYSEGFLRRSERFCDKIGASDTPTMADDQD

SEQ ID NO: 1279 - protein, 33 aa, Homo sapiens
YGHGIQKKPLEMPSLIKKSCRKLIRLSWSYSIH

SEQ ID NO: 1280 - protein, 28 aa, Homo sapiens
RKRMTLGHERSWSTGKKDSPSLTTFWNN

SEQ ID NO: 1281 - protein, 97 aa, Homo sapiens
EHPWRRHGHGVLCRCHGSLSQDLSCHSYSSGKCPPGRGGRIRKAEPDEVGFIHCWLRFLPDHSDEILQHIKSDGRSEGFVSNSWSARQRNHFYFHRQ

SEQ ID NO: 1282 - protein, 85 aa, Homo sapiens
IWWNLANSDSFQMSLTRYREMRKCGKFGLIRKTRRRNLFQMPMINLLTASDVFSLLDPGVLTEPSPRPASTSWTPWEKNMPKVLF

SEQ ID NO: 1283 - protein, 16 aa, Homo sapiens
KLTWKKAVPCPPGRNP

SEQ ID NO: 1284 - protein, 80 aa, Homo sapiens
AWGEPLLDLQAQAKQKPLKTWDDASGNTSWFSIVQTRWISEDLDGFLRDWHSLDPGVVLMNLTVLIYQFSRLQPSKFPLF

SEQ ID NO: 1285 - protein, 12 aa, Homo sapiens
ATTVLRGVSQKK

SEQ ID NO: 1286 - protein, 49 aa, Homo sapiens
AGQPGGKGKTSLKVGARDLCRPPLLLSCPATRGSRLPILMVHTSSHQRG

SEQ ID NO: 1287 - protein, 48 aa, Homo sapiens
PSWSSSPVPPSRRARTASHQSPVTRQHPTPSPQPRCLSPDTRPSASKN

SEQ ID NO: 1288 - protein, 42 aa, Homo sapiens
RSPPQLLRPVPLLCRTPRPSKRRPRTPPGWTPREQPIVHKGS

SEQ ID NO: 1289 - protein, 32 aa, Homo sapiens
PGPAAARHHRTAPCHPPRSCPCPSPPSPRSPR

SEQ ID NO: 1290 - protein, 26 aa, Homo sapiens
KSAPGIFAGPPSFSVAPQPGGAGFQY

SEQ ID NO: 1291 - protein, 66 aa, Homo sapiens
VPILPELRAESDRGQPQRDTTEQPPAILPDRAHVQAHQALGPPADPRAVRGLHVPGGGHHRAHPAG

SEQ ID NO: 1292 - protein, 52 aa, Homo sapiens
RNPNLKRKLKRRNWNPKGLWNSVDIIQKKRKSNLLSQQSLKSYHCLSQRLYV

SEQ ID NO: 1293 - protein, 27 aa, Homo sapiens
LRVLSSIQLFFKPQICPMILRTLSCTG

SEQ ID NO: 1294 - protein, 92 aa, Homo sapiens
ERRSLFQPSSLLTTMISPGPKSPAIWPGWWPKPLGQKMCQRNFKNHFTQISMTRNTSNHLLLICFYRLNYTVVLGVSFSRVMLQNPFWAMML

SEQ ID NO: 1295 - protein, 21 aa, Homo sapiens
NKKNSDQNLFTEIILNPPKHQ

SEQ ID NO: 1296 - protein, 21 aa, Homo sapiens
TPSSSSKTKKTATKIYSQRSY

SEQ ID NO: 1297 - protein, 59 aa, Homo sapiens
MWQSCSLIVNTRRTMRTPKPATIPLGTWLASQLQRWPRMSLPMSTTNSHCIITHTYLTP

SEQ ID NO: 1298 - protein, 44 aa, Homo sapiens
CGPSMWPRSRVTGSTRRSLRSGRPSSAAQWTCWGWCWPRSVRSL

SEQ ID NO: 1299 - protein, 43 aa, Homo sapiens
CGPCMWPRSRVTGSTRRTLRSGRPSSAAQWTCWGWCWPRSARP

SEQ ID NO: 1300 - protein, 43 aa, Homo sapiens
CGPCTWPRSRVTGSTRRTLRSGRPSSAAQWTCWGWCWPRSARP

SEQ ID NO: 1301 - protein, 37 aa, Homo sapiens
PRSRVTGSTKRTLRSGRPSSAAQWTCWGWCWPRSARP

SEQ ID NO: 1302 - protein, 31 aa, Homo sapiens
ITKQNMKVKSSSAISPLILLLLSSTKSMPIT

SEQ ID NO: 1303 - protein, 106 aa, Homo sapiens
GPGMLLILPVRLSISNQQKWRKPISLLWLILQRSFMPNKSRIFQARKSTRKMLRSPCRIMRLFWTPQRYRESGRTKRTSAFSNTSVTLKTVKEKLQLFKTRQKYCV

SEQ ID NO: 1304 - protein, 90 aa, Homo sapiens
RLQEPLETLPVITNTRKPMNKPKGNTLASGAWKMTPSWCTSCKWPRCSQTGNTRRDMRNPRPPSTPRWTCSVWWQPRSLRKWPPMPTTGT

SEQ ID NO: 1305 - protein, 84 aa, Homo sapiens
RQPKTRVIANIEKIMKSQKLSTRHLLICSKSLKLRNLRQLPATLIISTSYTVTATPLIASMWTLPRRHMRCRAMLNTKLTTIAG

SEQ ID NO: 1306 - protein, 81 aa, Homo sapiens
QRNKVARSSMILNTGKTGMPPNQSTPSQKPPCCTLPRRLLGYWTSISTRKAGRDKKPQVTFCLQMLCHLFMPITAMTFRVS

SEQ ID NO: 1307 - protein, 14 aa, Homo sapiens
SQDYVCHTCRKNSK

SEQ ID NO: 1308 - protein, 12 aa, Homo sapiens
KEQRENDWSPQH

SEQ ID NO: 1309 - protein, 12 aa, Homo sapiens
KKQRENDWSPQH

SEQ ID NO: 1310 - protein, 66 aa, Homo sapiens
NIKKHLIKQRANIRFHQIHHISPTPKTWENSTVLYCIKGRGRAPRPMATPWMSATFPLLEPSMLIW

SEQ ID NO: 1311 - protein, 53 aa, Homo sapiens
SPSITIGRRPPKQPAPEPIVGTAGRPCSGGLRLAPRPHPSTHPPDPRPVNSWT

SEQ ID NO: 1312 - protein, 41 aa, Homo sapiens
SPQSWTPCTQPPTPWSTLPGTAPSPSPRPPGPTLLLLSTRA

SEQ ID NO: 1313 - protein, 98 aa, Homo sapiens
LPVPTWLASPTRLALSPTLCLDSPHTSTRCFATQFSAPPTPVTCLGPSHPPCQQPTSCRPCMPSRPSCRDWPWSSSGCMDTPTCMVATYQVRKIITVD

SEQ ID NO: 1314 - protein, 92 aa, Homo sapiens
QRTKTKTKTKRRTGTETGTERERKETKQERVRIQGHAGAVPWKEEPKIMLRVITVKTRTMTTIVPPQRSPRRRIRRNHRKKSLVMKGQIPVR

SEQ ID NO: 1315 - protein, 192 aa, Homo sapiens
RRKPLPLLRVTNASGRRWPLIRRRLTGPAPRRQKRRRSAGPTRHLKVRERVQTVAASTMRVAVTPKTSTRTIAARPRASPAPRTMRVTRTRQPSSRCCRPSPQPCRLPLGSPQLPPQLLQGPLSCPRQGPRPLPLQFPHRAPPRPPRPLTSHRLPQRLFPTPTSNRHRPCTPSGRPHRIPRRIPRHIPRCSL

SEQ ID NO: 1316 - protein, 78 aa, Homo sapiens
HPTSLKMMWSTDQETVCISRVGGQTHRISSVAFKTSNWSTTPRPVADLQLLLCVTPQHALCRWHHSHHSIFLKPGEGL

SEQ ID NO: 1317 - protein, 175 aa, Homo sapiens
RGGRPAHSPPSRSRRRLWTTLRSLRAPLPHQGARPRSPLWWTPPVTPASQLGSTNTWTGATTRVPGQTCTSCLWPGPSWPRRGRRPLRRPSARLSRKPERSESGRRRRRRSGSGSESGSARQSGRLRRPAQRMKVASVTHSSVVLATCGHPSSHHQPPLLLCPPTSGPTHLPFGL

SEQ ID NO: 1318 - protein, 48 aa, Homo sapiens
RPPPRKTWGLPISANFAIGPLPASTLLNFTLAKHTGNLRKTTFCMSLS

SEQ ID NO: 1319 - protein, 43 aa, Homo sapiens
HPAGAHCPHDGHWPLHQGHQLCYEKGEAHCGDACHTYHHNPAG

SEQ ID NO: 1320 - protein, 40 aa, Homo sapiens
MWRSRRKSTRRKRSLTRNLSKKTSLAKKRRSVTSLPNTIT

SEQ ID NO: 1321 - protein, 37 aa, Homo sapiens
LGGLSQHPCRLPTSQHDEVVPGLVGEEHAPETHVWQQ

SEQ ID NO: 1322 - protein, 110 aa, Homo sapiens
RPCTTTSSPTPTGPTSTSTCTSPPRRRTTAAAAAAVAAAAAVAAGASTGTRAPWLRRCSRCHRAACSRSPASSAPCSCTGRAASSMAPSSRGPASSAVRTAALPTTPWWS

SEQ ID NO: 1323 - protein, 28 aa, Homo sapiens
HPQSTRPRTALLAGGAIPASMPPTNFPT

SEQ ID NO: 1324 - protein, 66 aa, Homo sapiens
RSRMGSFPRPSGPLPPHVAAKSGNPSRWRHPAMGASAARRTAPAPRGMGARMGAPSLSRWRMARSW

SEQ ID NO: 1325 - protein, 236 aa, Homo sapiens
ASGQQEPSAGTARCQPVGEPGCAQRCQWLGRPAPAHVAARIWPARNVGAGRTGDWWLWTAPCRKRSPPATPTVHLLHRVHPSWRLSPSPGLPSGLRCPATVQFWLRASTSTARSVCPSGGSSSTSHSRGSTSGFPTASVSGCPGHEQAPDSSARLPLWSVCRLRAGLEWLRTGLLRPQPAASFLRGSLRARVGGPPRRRQRLWTRAEPQRARVPPLPTLARGAATSARPRPRIPNL

SEQ ID NO: 1326 - protein, 235 aa, Homo sapiens
ASGQQEPSAGTARCQPVGEPGCAQRCQWLGRPAPAHVAARIWPARNVGAGRTGDWWLWTAPCRKRSPPATPTVHLLHRVHPSWRLSPSPGLPSGLRCPATVQFWLRASTSTARSVCPSGGSSSTSHSRGSTSGFPTASVSGCPGHEQAPDSSARLPLWSVWLRAGLEWLRTGLLRPQPAASFLRGSLRARVGGPPRRRQRLWTRAEPQRARVPPLPTLARGAATSARPRPRIPNL

SEQ ID NO: 1327 - protein, 189 aa, Homo sapiens
SMTPRSRGPEVLDLLLSRTNNQWTRLSTCIFTTSWAKKWKLNELSLGTARAKRRDSQVPASGGAGLCPTLPMAGQASPRPRGSKDMARKECGCRQDRRLVAMDRPLQEEEPPRHPHRSPPTSCPPLLEAFPLPRASLRATVPRHSSVLATGLHLHRQISLPLRGFLLHQPLPGQHLWLSHRLRLRLPRT

SEQ ID NO: 1328 - protein, 186 aa, Homo sapiens
ASGQQEPSAGTARCQPVGEPGCAQRCQWLGRPAPAHVAARIWPARNVGAGRTGDWWLWTAPCRKRSPPATPTVHLLHRVHPSWRLSPSPGLPSGLRCPATVQFWLRASTSTARSVCPSGGSSSTSHSRGSTSGFPTASVSGCPGHEQAPDSSARLPLWSVWPGFLFSSPAGLRPTLCLQSYGQAEQ

SEQ ID NO: 1329 - protein, 81 aa, Homo sapiens
AVMWPSRLRAGLEWLRTGLLRPQPAASFLRGSLRARVGGPPRRRQRLWTRAEPQRARVPPLPTLARGAATSARPRPRIPNL

SEQ ID NO: 1330 - protein, 71 aa, Homo sapiens [sequence omitted]

SEQ ID NO: 1331 - protein, 159 aa, Homo sapiens
RREAEAPRWKLNELSLGTARAKRRDSQVPASGGAGLCPTLPMAGQASPRPRGSKDMARKECGCRQDRRLVAMDRPLQEEEPPRHPHRSPPTSCPPLLEAFPLPRASLRATVPRHSSVLATGLHLHRQISLPLRGFLLHQPLPGQHLWLSHRLRLRLPRT

SEQ ID NO: 1332 - protein, 55 aa, Homo sapiens
VKMPVCPPWVLCQQQLNHPLLEFGNSGTKILLRIFEIILFTNSSKPYFLRRILLL

SEQ ID NO: 1333 - protein, 49 aa, Homo sapiens
IKNNFPREKMTHWILNCLLNVQSAEERCIRSVSFTMRSSGLLDSSVMAV

SEQ ID NO: 1334 - protein, 20 aa, Homo sapiens
TLISGPLGVRQRWHRFWLSI

SEQ ID NO: 1335 - protein, 76 aa, Homo sapiens
FSLQSSALSPACPFSTATVPAPPLQSFPKDAASAFSTPRFPTDKFPTSWTGSCPGQPHGTRAFCQPGPEFNAFSAC

SEQ ID NO: 1336 - protein, 73 aa, Homo sapiens
APSSICSQIRPSPHTYKASRSLILSPIKCALPSLSLLHGHSPSPPTPVLPQGCSLSLLHTTFPHRQVPHILDW

SEQ ID NO: 1337 - protein, 66 aa, Homo sapiens
VTQQGIFGHVHQVREMIISSIAILLTRRYPSPSDCRNGTKKCLTRLYQSVLSMTTRIFLNKLLKID

SEQ ID NO: 1338 - protein, 138 aa, Homo sapiens
GARRGLSSHLGGSRQLGTAHPAPSPHLPKKAETHSVPRQERGRRDTPLNSPGEGFPHLGFMKKQTAGEPTPGTPPHKDSEPLRPPPKGYQQEDHLPCLVPLAQPSAWASGCHSGMRPRVRSSSSGSQSLSVLQPLSKA

SEQ ID NO: 1339 - protein, 27 aa, Homo sapiens
GPPPHPPPDPAGNGEQGRGPPERWHHS

SEQ ID NO: 1340 - protein, 93 aa, Homo sapiens
KSGVPVRRAQGLGSSLAVGSTSPGWLGSGLSLGVLMTKPSKNWLRGPHPSLKWTWKPGRQPRLAPLSQLLPQDREASKGSWEPDRVGPGQRQA

SEQ ID NO: 1341 - protein, 69 aa, Homo sapiens
RTWCCVCWSWAAGRGALVLRRPHSCSWRRRSRRRCGGSWPCPRPTPRRQRPPGASPATSATWTRWCRAL

SEQ ID NO: 1342 - protein, 99 aa, Homo sapiens
AERPRRPRPRSRGARKPGKAGGGAHGGSPSQRSPRRPRSQHWTRAWAPARVQCQDPPGSLLGLSLAQPEALKVAARLRCQHPQHHHRRRVQCSLSRVRR

SEQ ID NO: 1343 - protein, 81 aa, Homo sapiens
GTGAAEGAHSEPRGRGGRGRGAVGRGSPGRPAAGPTAGVQARGAPAAQEASTGQGPGHRPGCSVRTPPEASWDCRWHSPRP

SEQ ID NO: 1344 - protein, 80 aa, Homo sapiens
RSWSPPLAGQTHSPSTTRALPQPRPTIGMNTSTPTCTWLATTVATAMCGKPCRPGRTRPLSSRTTTTAGKTRRSTRSSLK

SEQ ID NO: 1345 - protein, 67 aa, Homo sapiens
RRQPACWRRARSGRGSKARAPRAKVPPSRTLSASPTCCDSTTASANGRRAVPRLCCTWAGPPFLCSP

SEQ ID NO: 1346 - protein, 147 aa, Homo sapiens
QCSGVRAARVHSVREGEQPAGLPHLHGVCARRGRAGERAGVLLAGGAAGGRARVVELHFGARGERQGVRAAAAGPRGARAAAVSGERARRGRAASGQQRDAAGVRAGRERQRAGAAGASGGWYWWCSERAGAAVTGCRPSGGEGARS

SEQ ID NO: 1347 - protein, 45 aa, Homo sapiens
AAAPGKQRSLPVSRGAVHGRDQHHSCPGRSGLSAPPAAGAGERPR

SEQ ID NO: 1348 - protein, 150 aa, Homo sapiens
ACFTISGALHPRTFLCRCPTAPMGRASRGSPLWQKSLHISSTSQCCSPPRRPCRSIKGAWLCCLQSRTTRLTRPSTTTFLSCSPPAAPLHPSTMGSRSPPLQGRAPQPRSWTGTRRRRKRRMMKMEKMRRKSPSASGKGSRPFLKLTRNT

SEQ ID NO: 1349 - protein, 47 aa, Homo sapiens
VNQPRSKPLWMWRSRLVLLLPCLTSQRPRSLGSWNRSGPRSCRESRS

SEQ ID NO: 1350 - protein, 131 aa, Homo sapiens
AQVPFARDAFHRDQDHRHRQPPHPLAAQWRPGAQRQPRHQQRAVGPGRAILQLCRRAAQARQTGGGAQRVLTEQRVVPRVLSGHQPQLPRQHTQARAHGPYHRPPWGPQRAQHPPRGDHRSNQNREWCLEE

SEQ ID NO: 1351 - protein, 44 aa, Homo sapiens
AASRPPCPLRPPTTAPPPAHPSACPWALSSSPLGATACPAPPPW

SEQ ID NO: 1352 - protein, 19 aa, Homo sapiens
WALSSSPLGATACPAPPPW

SEQ ID NO: 1353 - protein, 146 aa, Homo sapiens
GRGGKRRALGTRKSHLPLSPQKVSLAAPGHLMLLGTFPWSPPSHQQNQVNQCPPWRDPRASSQGLPSQGPVQNQGRRGEQRPKKFLSSSTPAPLRNLILSSSRVAWKGKTNLWPSSHHPHLPHTDALLTPCSLSWSASPTFRFLRS

SEQ ID NO: 1354 - protein, 122 aa, Homo sapiens
SRRPTAKSAKRQGCWRSWKPKKEPVTTCSRTRKDERVQRLWRSTSFRTWRTRTQTQTWTKTRMRMRRRARMSCPDHPQRRPRLAHHMHCGQTPHPSWALSPQMPPPLARRLHEAARSRKLSA

SEQ ID NO: 1355 - protein, 248 aa, Homo sapiens
QGPGRPRSEAAGVPLRARQPPCRLWLRSPNSHSPQSWRAGTTPRRGRGPAEARAGLLTGHPMGPGHLQSPHPRTAPAPHPTPCPGRPRDAGQRSPGAPAWSPRVHRPTPSLLPPRRWTAAALWAAWQRPLPASQPGRGTSPGNPGPGRTPPSPQEVGSPGHIHISLRTGFPPTLSLSPTASASGFQCPATDVSSHFPRIIPLPQPHLSLRPGALTAPSVVPSHVCSYLCLFLHLLLLKKKQNKSHTYI

SEQ ID NO: 1356 - protein, 34 aa, Homo sapiens
EATQCLLPPALSAPPTTPSEVATPSMTISPTPKP

SEQ ID NO: 1357 - protein, 199 aa, Homo sapiens
PKTTHLPSDAPRPENHRPQPQAHLACTWTQEGAWALSLVGLQDFSCLLSPSAPWEENWPLEHMCSPNSRVPPTQASPDTRPPGDGLQVRPSHHHGQRRQGSGPWLGRAAPQRGSMAQAWGWTHGFSSRPRLYLTSSSAEAQRPAPPRGRRPSPEVPPAHPALLILSPPDPSPPSMTSTATSWPGQRRTSSATCLCTPST

SEQ ID NO: 1358 - protein, 198 aa, Homo sapiens
PKTTHLPSDAPRPENHRPQPQAHLACTWTQEGAWALSLVGLQDFSCLLSPSAPWEENWPLEHMCSPNSRVPPTQASPDTRPPGDGLQVRPSHHHGQRRQGSGPWLGRAAPQRGSMAQAWGWTHGFSSRPRLYLTSSSAEAQRPAPPRGRPSPEVPPAHPALLILSPPDPSPPSMTSTATSWPGQRRTSSATCLCTPST

SEQ ID NO: 1359 - protein, 79 aa, Homo sapiens
LRSLTGRTQSQSRPLRNLRRLRSSNGPSAARHLPSSQLRSCHPKRRGCAWQRWPNHQGSPASSPLCLCLAARARKAMSL

SEQ ID NO: 1360 - protein, 331 aa, Homo sapiens
AGLQNLSWRLPPREDRRAKNHSPHPVNPLPKAHCPRFPLRPPHMVDPREARAQGRTGPHWGPLCPTQKHCKCSTTPLPRHPCMRSHTCPHQSPFSPSSISCSMSQDSLQNSSPPRPCPASCPHHTPCPHFLPPYFKPHRFLSSLLFCTQANSISPSSCLTQPTSPSGSPLPSSPCHTRPPQHCLLGFSCLCNPSLHFSSLVMWKAICPRSKPAWPHWQQEVLASPPAQSTAVTSGYPLWLPQPAPQHLHQLLHWPCLPVQTPWCPWLCLSVFRPICRPMGAQCTPPFPRSWSPSPKAAQQLWHFPSLRNPHQRGRLYVVQMCMRLGPALLG

SEQ ID NO: 1361 - protein, 141 aa, Homo sapiens
RLLEHPPAAAEPSVEVRGHLPQEGRLQQLQCAPHRGFLRDPGRPGPRHHLPGPGAGTDAGGPGGRQQGARIPDAVPGGIWQLGGDWRRGCRCGPASGAGRSWLLYPPQEEEPACPPVPGGRLLLQVRTTEAPEDIRGPPHI

SEQ ID NO: 1362 - protein, 228 aa, Homo sapiens
TWRSAPWGRSPAKASTWPSRISVPVWRCSPSVSTTRSAPSCCRAWPTSLRPSPALMHLPWPLWPAPVWTMPWCHRGVKSPVCTVQWMASGWCPLGSACARQATRRWRMPARPARLDFLSLRHLRAPAWSALSTRCHPLRVPPPASVRKASSGHLRTQRRCLAHDPPPPHTTSQPWAWVPRWSCAGRPLRTAGAARTLSTASPANSAGPSLGNAGRVRPVCATRSLLTD

SEQ ID NO: 1363 - protein, 63 aa, Homo sapiens
DHRQQRLRGTPREAERGGALRGAAHPQRLLPGLPGYRCLCGAALRPCLLQEVPRAAAGPGPLP

SEQ ID NO: 1364 - protein, 54 aa, Homo sapiens
ARQLRWPWTWLETEPRPQRRWMRASSPQARTWRSRMTRCPRPPSPALTAPSPWW

SEQ ID NO: 1365 - protein, 28 aa, Homo sapiens
PWTSGTRGSQPLHHPFPPSHPHPHLPHL

SEQ ID NO: 1366 - protein, 94 aa, Homo sapiens
GTCARSMGRWRRWRFCTTPRPRSTWASPRWSLPRSGEPRMPFSTCTALPSWATLSTWSWTPKGKPECGSMNCWSLADTPPRPSQWASWTLSLQS

SEQ ID NO: 1367 - protein, 92 aa, Homo sapiens
WPGKRRKKRRRRRWWPRKAWLLQALRTLSRTGRKRLWPRGHLQWTRWAWKRRWTSRLRLWPLRSGPPCWTSPPCLWVLKSQRTPGSRLRNQA

SEQ ID NO: 1368 - protein, 200 aa, Homo sapiens
PSRPGATRASSRTPTTAATNIIMYTILPRSLRWPGPQPLSGVPRTSRSEQSAALGAAAVPRSRLNHRIQPHLPTLHHPPKQPLLLDSSLLSLRIRPQWPTSLHPRKSPPPQPLLGPATVGSSGGHRRPHPCHLLSLWPRRSQARHPARRPPTPTAWSWAAGPPSAGVLSPVTALARPRWSRPLQGQRNPTTAWTRASRCC

SEQ ID NO: 1369 - protein, 89 aa, Homo sapiens
GSRTRTPSCRWRAAPSPPPPPSSPHWPPLAPTPSQASGAPRPPRHAPPAPAWRISAQHPSQTPTRTRSSTWALGLGLHLSQAPRTLLGF

SEQ ID NO: 1370 - protein, 44 aa, Homo sapiens
WRRGWQRGCLLQGQRLSGGCLWPRGLCRLPRGRRGKGPKMLSLC

SEQ ID NO: 1371 - protein, 72 aa, Homo sapiens
LQGRGSGGPSRTPTPARWPWCSTMSRGFSLPSLSSRMWWKQCRADQAQVTLKNCPVESGMLWPSSAWTRPAS

SEQ ID NO: 1372 - protein, 171 aa, Homo sapiens
LYPTSVASTTRINEQTNEGHKRKLDWPGSGQPKAEAQMLTCRANGMVYSVISCSPQRMSRLLLANPAPALKPSTTTCFTAWKKPRITSLWTNKSLKKAAWKLQLLIVLQVTVLHCLHNKESPAPAVHDDTKKLFASQMPMYQEAIKVVYKNSARFRSDVWREHLCLTADPV

SEQ ID NO: 1373 - protein, 292 aa, Homo sapiens
SFSTNCVYIRTKSSTSWHHKPANSSRTPRDSRAFFALSEPYHSPSNCCCRSPPSSSTTTCSRTAPCTTAEFPSATLCSTCSRACSCGHPWVAYSFSNCWTPLTPTPTPSWSCPSSPSTTPSIHRTPRSTSTTPACCKFSTPTTPSAATFQCFGFWASYHISSSLTPPTSSRTSTFSFECSSNCTTVSLTSYTSYHFGTGTPAPAFWNRATLSITCHRSSSPAPRTKQYSNTYCFRVLSSSWLCGPATWGSRTSAGISSAWTDSNSQSTGATNISKQLPWVRVALKWTPKTFF

SEQ ID NO: 1374 - protein, 27 aa, Homo sapiens
DQTEKRKKRQRYFKRKRYTKSEYYFGL

SEQ ID NO: 1375 - protein, 87 aa, Homo sapiens
LLQEFPKLMIKEGKKAGRKNNTFQNVKRHFVKDLGSHQELRVQLQRLILHLMVQILDGRQRSKHGWIDMKKQITTSTVRVFRGRHKE

SEQ ID NO: 1376 - protein, 82 aa, Homo sapiens
SVVTNAAFGNILTAWGLIGSIFLIHIYVNVVSLGIWIKRGQCYYNAGKGKICQMVIPVQLRVVMRFLWNYILHFSILQHQLL

SEQ ID NO: 1377 - protein, 161 aa, Homo sapiens
ATMVMAVPAVMTMGSRWTTLLAYLYQHQLQFIMPLLKKLAITALLRMLLLVRRMNQKFNGLPQLQWNKSEKGVIRELYFSVITEKIKIVGENHHVSHVHRVMFSLHLHLIQITYPSCKLRAQSLLSVNLWKTLILKIQNPQLRMNVHPQILLKILVKVLQK

SEQ ID NO: 1378 - protein, 50 aa, Homo sapiens
EKESTRVEGKGSKNTTKGGRKSKKIRGGTKDKRREKKAKGRGKEKERKRI

SEQ ID NO: 1379 - protein, 29 aa, Homo sapiens
QKNDVQKNWSSKKENMKIQITKLNWETLI

SEQ ID NO: 1380 - protein, 25 aa, Homo sapiens
KKREKSKRKRKGKGEKKNMKKKRIL

SEQ ID NO: 1381 - protein, 18 aa, Homo sapiens
KPSKKTMFRRIGQARKKI

SEQ ID NO: 1382 - protein, 147 aa, Homo sapiens
AATLGDLDHHGLPQLEGPSLASIPVSRPRLPPTVESSAPSASTFTSRPPHQMPCAGYLSLGSGQGRHLEKGPPDGQRSLGPEGTRSLGCPHPAEGVPLAPYPRGLYIDYKYIRGKGVGGEGFWGWGLTSPPPPSPGPLSLGLFVKKE

SEQ ID NO: 1383 - protein, 271 aa, Homo sapiens
SLWVVPLFSKRIISKSLISWIRRMMMVGQGPMKRLTTLKSSSSAMRKMGETLMRRVLRATGIPNQLLVRNGPLKQMAKRATPPTANRPLLRRPGQKPLGLQRQSRDLLPQSLPYPHLTGAPPGTGAPLGTTQIVGVLPASPQHLKMRMRHGGSDESSRHLRFPWQWSGPGDGEKKRSGACKKSAGQPVLRSSSDSMKSLGHLTSGSKQSLLPHLLPLLPQLHHLQSLKNSLHLQLHLQHQPQHQRQNLKSQHRPLLPNLLLLQVWLRLPLW

SEQ ID NO: 1384 - protein, 47 aa, Homo sapiens
CRLSCIPHISRSLRPMDPRGLTDTPLLMGPAVFPVWRAPEAQGHQCA

SEQ ID NO: 1385 - protein, 109 aa, Homo sapiens
QHQSLRPFLYHETGSCFPVLLPLLSHNPRTWILGTVSRSPAPQASACILRFSMAVLGLPVLRSLGEPWTLNYIQTVEASALGHPHCTLTDHSPYTYPPAQPLPQHCSLG

SEQ ID NO: 1386 - protein, 37 aa, Homo sapiens
WFCFSSTHLSCHPESTDVQYHLRFSISYCCKNTDISG

SEQ ID NO: 1387 - protein, 30 aa, Homo sapiens
DSRARRRFSPSAPSPLPAPFGGGPRDSGRR

SEQ ID NO: 1388 - protein, 101 aa, Homo sapiens
GGRPGNSRSWRRRRGSGLQCLSRSVSGEDTRGPACGSRPLSWAGGDRSGWNSGWRSRFGVRVPRSRVCGRGTGGSWTDRGRYCCWRSWCCCWRGRCCCCWT

SEQ ID NO: 1389 - protein, 16 aa, Homo sapiens
RRKITLPSCTTRASRR

SEQ ID NO: 1390 - protein, 15 aa, Homo sapiens
GFFFTKSLNRCCYAH

SEQ ID NO: 1391 - protein, 77 aa, Homo sapiens
LVLLLAWPVLLLLDLVETWLSPNCPLRCLLRLSGQAAVFPLCPLPLTCPLWGRASGQWTKVTLWMDQNTRRKRWPYR

SEQ ID NO: 1392 - protein, 46 aa, Homo sapiens
SASLWGATKTRKTPGSFMPSHLVSSPSSSWIPLPRHWPNLKKITWS

SEQ ID NO: 1393 - protein, 103 aa, Homo sapiens
VVTGTPLEVVEARDHFPLVALLWDTETTGCSSWLLAACPLHLRHHCLETWREKETTRSMRECALHTVLSQGWELEQVLLLSEKWMRFHPRMISELTGRSSWAT

SEQ ID NO: 1394 - protein, 97 aa, Homo sapiens
GALVAAMGAAAERPIAAVGRGGVSTWTSPAVEVAAASMIPVGAAPVAACIVIAPRAPKILRAGASRAAAPGVEAGSHVPLGPPPQLPAAGTARNTRL

SEQ ID NO: 1395 - protein, 106 aa, Homo sapiens
SSLVPVFWMKKSLRVMSRSWPLSQGSRQPMNHVNRRSWNARGARGKDPKTNSLTEPRDLHSSNHQDFTGHKIRNPRARTPPQVKRKKSWSRASCHPLRRLPMDPEG

SEQ ID NO: 1396 - protein, 100 aa, Homo sapiens
WPPWAPWREGPPWTSGSQRVSWTERTPGPPWEGWAAGTPRPKRRSGFPREDRPPWSSRSGGTSGSSRRNRPYGGERSPRPPGAPWRAGTTWDSWKRRNKG

SEQ ID NO: 1397 - protein, 99 aa, Homo sapiens
LVPLASRGTQAQLETLERGAPLAEQGSLDQMGLLVLLAHLSCSHSGLAVVGVTRALWWRPRRLRPRRSCSRRGWRSVDPLAPWDTQGALDPWANLGALA

SEQ ID NO: 1398 - protein, 97 aa, Homo sapiens
LRGQPLIIRTPPQVKRKKSWSRASCHPLRRSRQISRSPPQPTGSRQRNMGRVAQTPLKGPTITPMAMGMIIVRRQSLALPSLRRQPTQEPLPMDPEG

SEQ ID NO: 1399 - protein, 93 aa, Homo sapiens
SSLVPVFWMKKSLRVMSRSWPLSQGSRQPMNHVNRRSWNARGARGKDPKTNSLTEPRDLHSSNHQDFTGHKIRNPRASPLSLSTMTTSPPIMM

SEQ ID NO: 1400 - protein, 85 aa, Homo sapiens
SSLVPVFWMKKSLRVMSRSWPLSQGSRQPMNHVNRRSWNARGARGKDPKTNSLTEPRDLHSSNHQDFTGHKIRNPRARLPMDPEG

SEQ ID NO: 1401 - protein, 81 aa, Homo sapiens
LGPRVSRERREIGDFLGLRAPLGRRVRWVSQEHPAPLVLEVPPASPDLLAPKEPKEPQAQADPRERRVCRALQDTRVPQAR

SEQ ID NO: 1402 - protein, 78 aa, Homo sapiens
SSLVPVFWMKKSLRVMSRSWPLSQGSRQPMNHVNRRSWNARGARGKDPKTNSLTEPRDLHSSNHQDFTGHKIRNPRAR

SEQ ID NO: 1403 - protein, 342 aa, Homo sapiens
RGMKVRLAPLALQAPLGNEVQQDQGDPLVRQGAQARRVPLEQQERKVSQVRRAPLARLAEMECRVLWGFLVLLGLQVWLERMETRVRWGTPDRRAPKGTRVNMALLDPLDPLVLWGSLEQREQMGSPELGDPRDTLEPKVMKEQEDSMGPQDPLAYRVCQAPLGRREKQEMWVLWDHLAPQDLEVQLDPMALMAHKVPQEVLGTWVPLERRGNQESQDLQGSRASQVSRVHAGNVERKESRGSQESQGHQGLKAPQAMMAPKGTLVLLVFLVTLAPLEKVALGARMVLRVTEARMVSQDSLDPLVPPGRMDPQGHLESEVLLARLVPRGDKEGREPREILAL

SEQ ID NO: 1404 - protein, 169 aa, Homo sapiens
DFLAFLVPVERREPGACRGSQGLGENGAPRVHGVSGDPEVPLGSLELREHLVVMAPMGPLERGASLDLRVPTGFLDRKDPRAPLGRMGCRDTQAKEEKWVSKGRPAPLVLQEWWDLREQQEKPALWGREVTQAPRGPLESRDYLGQLEKKEQRVTLVPLGPQGRMVLLV

SEQ ID NO: 1405 - protein, 50 aa, Homo sapiens
TPKMTEFFQKAFSSALPCLKEEIHKHSILSTSSCMNKKSQKNSLKFSMIE

SEQ ID NO: 1406 - protein, 41 aa, Homo sapiens
WKHVPRRTVHPQFQLQIQLMKSMKMELKGRVTLSLCALSPC

SEQ ID NO: 1407 - protein, 33 aa, Homo sapiens
PTTSPWWSCWQHAQRGKMSTLKSSVIPFSRWTT

SEQ ID NO: 1408 - protein, 24 aa, Homo sapiens
QLRSAHLCCFSSPSLWVFGRFLYQ

SEQ ID NO: 1409 - protein, 76 aa, Homo sapiens
AASLILPFQTIVPASRHISQFLFSYCNLPSEFTIAPGQTQRRKPQWNPVSELWLKWQKIVELPFQWIWTAKLILFS

SEQ ID NO: 1410 - protein, 44 aa, Homo sapiens
KEGRKRRCPQSLPLSPWPAHTLEWETHRITWDRCKRVQVATLLH

SEQ ID NO: 1411 - protein, 107 aa, Homo sapiens
QAPDQAPDPPPGGGRHPQSGAASPRKESESESCVSEKKGGREGVLRASPSLLGRPTPWNGRRIESHGTDVKGSKLPHCFIKTRDHFLNSCIILNPHKHFSLTPIFVI

SEQ ID NO: 1412 - protein, 83 aa, Homo sapiens
WQIEEAGQPAAPRLEMLWGKHLLRSILQITLTTAFHQTLQLLLALLHLSQQAQLFGLEMEDRPHRLLIMKDPYTLCKAELKIV

SEQ ID NO: 1413 - protein, 82 aa, Homo sapiens
WQIEEAGQPAAPRLEMLWGKHLLRSILQITLTTAFHQTLQLLLALLHLSQAQLFGLEMEDRPHRLLIMKDPYTLCKAELKIV

SEQ ID NO: 1414 - protein, 42 aa, Homo sapiens
RNQATWRKSISSISMPVCTHSFIAFMECTLATSSPFCVLITV

SEQ ID NO: 1415 - protein, 41 aa, Homo sapiens
KKTEAMFSSRLRGLIPPKNGFWNWNLTWPRKTTFFWNRRNI

SEQ ID NO: 1416 - protein, 83 aa, Homo sapiens
PLLQLLLEMSHLICHTLTVKSLVQLQVEKELLWEPQQPLLLQPHSVIRMTTCTFHSPRPQSHPPGRKREWILQDHVYTDNTIF

SEQ ID NO: 1417 - protein, 82 aa, Homo sapiens
PLLQLLLEMSHLICHTLTVKSLVQLVEKELLWEPQQPLLLQPHSVIRMTTCTFHSPRPQSHPPGRKREWILQDHVYTDNTIF

SEQ ID NO: 1418 - protein, 123 aa, Homo sapiens
TRAPRPGTSRRRSWRCCWRRRQPAAMRTGKRRFSLNGSSPSRRRRRTSPTGCRSWTQGARTRRTWTRRRRPAPRACWRSGPGGGPRKVSIKGPLRLLSLAPARPPRAPSPPWPPLHDEGRRPS

SEQ ID NO: 1419 - protein, 119 aa, Homo sapiens
TRAPRPGTSRRRSWRCCWRRRQPAAMRTGKRRFSLNGSSPSRRRRRTSPTGCRSWTQGARTRRTWTRRRRPAPRACWRSGPGGGPRKGPLRLLSLAPARPPRAPSPPWPPLHDEGRRPS

SEQ ID NO: 1420 - protein, 245 aa, Homo sapiens
RRRLRTHLKSSPQSNPRPWQLARSLKKLRRRCPVGAPGLASWSGRPAWPWTAGSAHRPLAAPPRPPRTRANHVAAQGFRKSPTAPEAPRRSSGTWTPSGWPAPWNCGGARSWWPPPALVPCSASPWTSATDTGPQGPPSRPQRRGAPPSPRATSPSSSRPWPRLSLQQKPRTESEVRKSQLSRRRSQATHPPSQTQGCPRALRSTLNPRLRGFFCIKPRIKNTAWRAQRSWRMQCPGTWCWKPPP

SEQ ID NO: 1421 - protein, 234 aa, Homo sapiens
TDPVHQGGEGGHHLPAAGAGPKGLGRGEPGLGDVGQHREPAGGAGRAGGLGRSVLRAPCACSPLPRRAHPEPPPHRGRPSTTKAVVLRNGQSEDPPADPHHAHGQHQAPTRPALPPASLGTGCPGGGCPSAAPGATCPPPGPDTFRVHHARGRPASAGRPGAPRRGWPATWGQAEVLGSPNVLPAPRLGPDQWLRATADKVCMSEDGPCTGAGRQSCRASVRPSEKDPESKAQE

SEQ ID NO: 1422 - protein, 230 aa, Homo sapiens
TDPVHQGGEGGHHLPAAGAGPKGLGRGEPGLGDVGQHREPAGGAGRAGGLGRAPCACSPLPRRAHPEPPPHRGRPSTTKAVVLRNGQSEDPPADPHHAHGQHQAPTRPALPPASLGTGCPGGGCPSAAPGATCPPPGPDTFRVHHARGRPASAGRPGAPRRGWPATWGQAEVLGSPNVLPAPRLGPDQWLRATADKVCMSEDGPCTGAGRQSCRASVRPSEKDPESKAQE

SEQ ID NO: 1423 - protein, 70 aa, Homo sapiens
RPPGGPPSCPRPTSSSHQACPPTCLAGHRVPGRRLPQCGAGSHLPAARTRYIPCTSRPGQTCQCRAPWSP

SEQ ID NO: 1424 - protein, 47 aa, Homo sapiens
DAPEGQLGGHQGRGQAQDPDGQPRRRRPLPLRGNQGTREGGIPGLAA

SEQ ID NO: 1425 - protein, 43 aa, Homo sapiens
MIKLPPRLGQRCFDGRGAERKFTYLGPSTTGVNFPSPEATITL

SEQ ID NO: 1426 - protein, 36 aa, Homo sapiens
WAIPAVSAPRWSGMVAIRRPGGTARGAPRTGTGPRS

SEQ ID NO: 1427 - protein, 29 aa, Homo sapiens
SSRPGSANGVSMDGGRKGSLLIWVLQQLE

SEQ ID NO: 1428 - protein, 35 aa, Homo sapiens
EMSIYREVFFLTVPQDLHFSPQPPHSEGRMSFHQG

SEQ ID NO: 1429 - protein, 152 aa, Homo sapiens
PRWLRWTKIQARTPGCPIACLRPASRDSSRWGSTRARCVQRGHCWTETRSSRASWWPSRTTASPLSRPPSRSPWLWPTASPKSWRTSAASSLWLTLKPQTSRCTWWWRWPQSPASSWSLSSCCWHSGCGAGISHACCRLLKAGWQVCPRHIL

SEQ ID NO: 1430 - protein, 33 aa, Homo sapiens
MWQMTTITLPFFLTPLTLPTFPKTTPGVPPSSQ

SEQ ID NO: 1431 - protein, 29 aa, Homo sapiens
DGVLLFFKYGTSRGRHLEDLRSGGGNNRY

SEQ ID NO: 1432 - protein, 41 aa, Homo sapiens
TLVRPWMVIFSLTCQTYYLNLDNLKKPRFWWVLIKMKGQLF

SEQ ID NO: 1433 - protein, 40 aa, Homo sapiens
LSLEKVQEQLQLACICFLLEAIHCSPEPFCKVDPLMLLGR

SEQ ID NO: 1434 - protein, 32 aa, Homo sapiens
NGGQILQNMGIQMRLRTIAQAGLSSKALNKNI

SEQ ID NO: 1435 - protein, 143 aa, Homo sapiens
RVCASSTWRSWRHCCETRPWTSRSSTWCVIPARWRVHGSARATASSVRAYRWCAAETRELTACPSWRPRATSLAPRRRAWAAPQTTTLWALWRSSAIVWLRRCRQPCSPLTGCRATTWWCGTRTWWETPSRHYGECTILWDCW

SEQ ID NO: 1436 - protein, 80 aa, Homo sapiens
ALFTAATSLSSSCIAPRAAGGATSPRWASSAQPPTRWCARHHSAPPTARRSWGWWTTACARSARHSAWRVSRRSAASTAH

SEQ ID NO: 1437 - protein, 171 aa, Homo sapiens
RCSVGRRWCCARAMHCCWCSLCSTSWTTSGTRSRCSSATPMGRWVPQRGQPEAAGGAQGRLRPGRPVLMPVWTSALLTALPLPPSGRLLQPRQGWRGLRPLQAMALGAPGASGTSGSWCTCSPRGALARRSSASYSTRIPRCSFSTSQCGMYGKNCIRGTPFPCRGQRGTC

SEQ ID NO: 1438 - protein, 41 aa, Homo sapiens
WEVTERRTAVQGQLWELRWQRGTSVSQCIPILAPTCQPSTP

SEQ ID NO: 1439 - protein, 34 aa, Homo sapiens
EKHSSISLGRKDKQRKRKEKTIIASRMLTLVETI

SEQ ID NO: 1440 - protein, 146 aa, Homo sapiens
AASAPPPLPSHSQLILGQCHMYVMSVGGRSVSSQNLLSTRSCILERTSMSMVSPLSTVWLSVKFRKVRLEGNVLNVRTVERPSIRVPPWLNIGRFMLEVILWNVRIRNVRKPSCLAPPLVSFRKYMAKTNSTSAGCVRKPSFIVLP

SEQ ID NO: 1441 - protein, 42 aa, Homo sapiens
PSSLKSSSLGCEQKSRRTVRSSSLCWRITRRCTNQKTTTTVT

SEQ ID NO: 1442 - protein, 23 aa, Homo sapiens
KLCLKPKNQPTGGGFVKMNLPTE

SEQ ID NO: 1443 - protein, 192 aa, Homo sapiens
FTLCLLVNKHFALEGCSMNVRSVGSALLIALTSLSTRRFMIGRSPLEAETMNGLSFAAWPLLTLKQVTPKSSMLKSKRGTNVRTSDNFLLPAKTSTQTRKSMTKRSLMARSLKARILMGRRPTARRPMVRRQLKTLSFKAQTWKTLRRMTLMTKSMNVRTVAWALWISQTSQTIRKSTAGSAWLTVGSTHIL

SEQ ID NO: 1444 - protein, 11 aa, Homo sapiens
CTNQKTTTTVT

SEQ ID NO: 1445 - protein, 49 aa, Homo sapiens
VLKAQARWTSTVRTWRTGHAKSPTAPPSPAPTSSTSSLLTSTCLEAPSL

SEQ ID NO: 1446 - protein, 104 aa, Homo sapiens
AQRQECKRSGPGVLVWRLARWASQPILWWKPLAPRWGHWASPSRGPHKPRSNVTTRGMAPAMCGTGPRSLGSTLCTSSVTMRTSETHPSLPTSCPPHLTASQIR

SEQ ID NO: 1447 - protein, 82 aa, Homo sapiens
AMAWSTSQPPSLLSPKMLEKGVCHWPWRAHPRQRSPVRTTRMAPAPCPICRLRLETTASSCASMTSTSRGAPSQPRSQVMTP

SEQ ID NO: 1448 - protein, 77 aa, Homo sapiens
SWTHRAGGTQWRWPWRTRVTARSAAHTDLPWRGHIPCMWPLRVPPSPAVPSLSMCRKPVTPTPAAPLGEACSPRVFA

SEQ ID NO: 1449 - protein, 49 aa, Homo sapiens
RSWLESGGSACRSTSGCASSAASWMTWNSGSRSARWWRPPTSWARTTSM

SEQ ID NO: 1450 - protein, 128 aa, Homo sapiens
AQQLPRRAGTWLRGRSQWAPGREADPDSGPGPICNAPEQVYRVSPCCHPAASRPRAICPGADGGDAVPQAGDGGLREEGCQQVLAERVLCPAAWEPRLLQGCQGSQRGSAIPRRSACQPGQGPGQRRL

SEQ ID NO: 1451 - protein, 38 aa, Homo sapiens
RPTPQAKTALSTPRSSSTTGGSSFGVWQTARRQLSPQP

SEQ ID NO: 1452 - protein, 237 aa, Homo sapiens
RSGRRSERERGRRRSGGNSRLLPNPQPVCLQGTWWAARQLLTPPGTEPSHGHHHPHKHPVLMESAQMESPHSPCWDNRDLSTAASPKGRDLAQGTKPMGPGERGRPGLGARPHLQCPRAGLPSQPMLPPCRLEAQSHLPRSRWRGCCAASRRWRPSGRRLPTGPGRTCTVSCGVGASAFTRMPRQPARECHTTEKCLSAWPGPRAASPLITESANMSSSWAYRMEKNIYSRPRMRQR

SEQ ID NO: 1453 - protein, 50 aa, Homo sapiens
SLLLVLKWHLQNIRNCRIPVLVMSVLLSISAGKGRKQNTHWASGRPSPEK

SEQ ID NO: 1454 - protein, 36 aa, Homo sapiens
SIQVSSWIVIQSIAHLLQISWLWEDSSFLLSLPLIS

SEQ ID NO: 1455 - protein, 35 aa, Homo sapiens
EGCLISPLMEVVAVFRDRNHPFHAVPNILSTRILA

SEQ ID NO: 1456 - protein, 33 aa, Homo sapiens
ITRARLCSNEFWIIASCAATSALPTAVYALCFG

SEQ ID NO: 1457 - protein, 31 aa, Homo sapiens
CQIGCTYQWATMAVPPLSWCLAPQSEGPWDR

SEQ ID NO: 1458 - protein, 45 aa, Homo sapiens
MKRSTALLRLLCSWLLTPSRPSMVTTTPVFTSGDFWPKRNCFQKG

SEQ ID NO: 1459 - protein, 44 aa, Homo sapiens
PPRSPSRGMKSETSRTVTRSLLLNHWIRKLMSSSLTPQSFVLIS

SEQ ID NO: 1460 - protein, 30 aa, Homo sapiens
TTLQSGIKRAQSCCLEWMPWGFTFMTLRTD

SEQ ID NO: 1461 - protein, 52 aa, Homo sapiens
KTLNPNMSISVTQKYSIITTSLLTQVKLLKQILGVQESLRLFFVEVKLHIKE

SEQ ID NO: 1462 - protein, 50 aa, Homo sapiens
GARTFCQWSCKSSFKSRFIGKDINEETPNLLLAVISIFVEVGSENRYTVD

SEQ ID NO: 1463 - protein, 130 aa, Homo sapiens
LQQRCPVFHFQVTPYLLTPLHSHPQAPLKEKMTSQRPQLLLVQTILPPKYPRTLWIMLVLLIPQVFHQYRRLTFPRTQTRRRPLLELTRRHSAAPPPMQNSTLPQAAMLSQMSQERGVQPAPFLQTQFPH

SEQ ID NO: 1464 - protein, 145 aa, Homo sapiens
GGAPAAPEGPIRTWSMKDVVVVVTGLAAMEPLTARRMMVGRTAAETTTTGTWTTVHILASMAARRASMTMTTHLRSRVRRIPTRPPRAPRLSVGGGGGTGTAPPARQASPETATIGTRTIGPSKGRRRRRRRMRRRRRRPVTSSC

SEQ ID NO: 1465 - protein, 132 aa, Homo sapiens
WSMKDVVVVVTGLAAMEPLTARRMMVGRTAAETTTTGTWTTVHILASMAARRASMTMTTHLRSRVRRIPTRPPRAPRLSVGGGGGTGTAPPARQASPETATIGTRTIGPSKGRRRRRRRMRRRRRRPVTSSC

SEQ ID NO: 1466 - protein, 103 aa, Homo sapiens
CGTNLQVRAGASPSSSLVTCRTLHDGWKPISTPSTSWARRCRCTTVTPSPRSMRTGCAISVASRTSNAERSASNVACPSQRQSRSCPSARGWISRHCHWVAGS

SEQ ID NO: 1467 - protein, 218 aa, Homo sapiens
SLGPTLCRCRLSLAPSLVLLLASTNNQPRRAVARALLPTASRIPSCHPLCSNLSSRALPILVLLSHRLPAPLPRNPTASTLFPTSLPTSTMRPPATTMTPRPASTMTPTPSITTMLRASSTCTGMGRGGPMFPPWSSRPTDIRRQGHPRRRAKRRRRSTRPRQLNRLPRTWNAGPAVSTNKKKTSKIASSLSAPCEMTRGGSQPLQMLAMPSSRRREH

SEQ ID NO: 1468 - protein, 83 aa, Homo sapiens
WSMKDVVVVVTGLAAMEPLTARRMMVGRTAAETTTTGTWTTVHILASMAARRASMTMTTHLRSRVRRSVASCSRTACKHGRFG

SEQ ID NO: 1469 - protein, 43 aa, Homo sapiens
ASIWFQGAGAPLCRKHEGQRVERSRATRNSQLLAQPPGHPDGV

SEQ ID NO: 1470 - protein, 38 aa, Homo sapiens
RKKKSLVRLSSCVPVALMSAMTTSSSQKNITPAILTCC

SEQ ID NO: 1471 - protein, 35 aa, Homo sapiens
SRTLQSSLRQWQSRSFPMRSMPLGRQRRTSSQTSI

SEQ ID NO: 1472 - protein, 139 aa, Homo sapiens
LSTRGPTRVRNLMNVTNVAEASVRDLISSNTIESTQGRGPTSVMSVGRISVRTPTLCVIAEPTRERSHTTVTNVGKISAASHTWFSTRELTLERSHMNAMLVGKASAGALISSHTRKFTLERSLMSVMSVGEALVKGQI

SEQ ID NO: 1473 - protein, 27 aa, Homo sapiens
RVWEKFWKKFSPDSASDNPHWREASQM

SEQ ID NO: 1474 - protein, 146 aa, Homo sapiens
TLGRAPGMSSLSPAASSGCWTRARAPWTFGLPVSSARRVAPAWFSWARRRRKKRRGKGKRRAEVKVGQEQMRKRSSRTDLSSCCRPGSLKTTLIAGVGGAWSVMARSTSAVRNSSLSVSRTSAGMTGSLLPLAIMPTTARVSARAI

SEQ ID NO: 1475 - protein, 37 aa, Homo sapiens
KSPRPTGPGPKSPSASSSSRSTRRAAWTQGKRPRKWA

SEQ ID NO: 1476 - protein, 37 aa, Homo sapiens
QARPGPHCPSTQQSSTTTACGAIAPLPTSNRAVCPPS

SEQ ID NO: 1477 - protein, 57 aa, Homo sapiens
PSSRAPSSRMWRSKREAGGEGTTEGRSSCGSHQTTWKRWSTPWPWSRRGSTWTRTAP

SEQ ID NO: 1478 - protein, 139 aa, Homo sapiens
PGTSSPVSPPWKPMLAACGWAVAALSWTAGTARMGCQLFTMGTPLPPRSSSQMSCTPSRSMPLWPQSTQSSCPLRTTAALPSRETWPNTSRRCWGTHSSPSPWRSLPTGSPHPTSLRGRSSSSTRSWLRAVPTRRCLHP

SEQ ID NO: 1479 - protein, 49 aa, Homo sapiens
VCHLPVLQREQCVELAAGCSMPGHHEQPSFPLLDLLLAQHVPDRGPVLQ

SEQ ID NO: 1480 - protein, 141 aa, Homo sapiens
VLPQKISSSWFCFKNRIWELGISSMFPSLELAVEIMKLALHGIISLGQNAQLLVLEVSKDRRWSVKGWMTTPLSRTITVILTVSHLKIKEPATLSPAHLSGSLGIGWNAARLVMVGCAQGQCSASGRSDLLRRRRWTTVVV

SEQ ID NO: 1481 - protein, 95 aa, Homo sapiens
HTGLSKKSPATTSHVHHSGWLWTGLSVLQNVVQDSSIGLFCARAVTFLRHSQLHNVQRKANLLSASAAVWAAALLLAGSQETGASVLLSVALDSR

SEQ ID NO: 1482 - protein, 58 aa, Homo sapiens
SLLLFFSLEHLLCPLVWQNSGHQTSKMLDWKVSNEPLGHFLYVLPFHIHGKLGCCHGR

SEQ ID NO: 1483 - protein, 63 aa, Homo sapiens
KVPPSSAQKTTFSSGIFNMTPWESQCGPAWAAGRGERLSWTMEYGQSRPRDTKPTSNIQVSYT

SEQ ID NO: 1484 - protein, 265 aa, Homo sapiens
GPRSPAPGQPAQSPSCCQRPTPRSSLPLPGQQRQTRSPSACWSLTSRRSESARSFPRRGTCTSWSRTRQAGPGASWWCGAPMPTCTTATRTPWSGSCSTWPLPRWSTVRTSRLCSRHPTHSRCARNTAASCCRPPATRTCMTGCTPSTPSWPGPYGPSSPEGGLPRCGSEPEPSRDSRQAQPIPSLILVCPVTCRPAPLLPDSPRPGRPPRGRPCQARGPVPHDQLCSQQRLCVSVLLAECALVEQVGRGWGGQGHRLRGFLLPF

SEQ ID NO: 1485 - protein, 125 aa, Homo sapiens
AGALGLPEVEVVPVHVSAGPAVGQRHLPQGGQCHQRGAEKEGTIPVCPPDGHTLLPSATRPAAPRGRQRPRDAALPPHHCGRGGPGPEERGHPLLDAGEAQAASGPDAGDVRPRCRGALQCHRGL

SEQ ID NO: 1486 - protein, 47 aa, Homo sapiens
LHETERNHWMYMNSMLSRVDGMWYKQIMTVGNIPSSLMIAERLQRCV

SEQ ID NO: 1487 - protein, 34 aa, Homo sapiens
IIYHLYFNSSRRQKRSSNTWEKHGFWSISWVEHK

SEQ ID NO: 1488 - protein, 92 aa, Homo sapiens
LPSSRRPPTNGYLTTVTLHCPPGVENALTGSLRSRDTMQTFCLFKPTRPSTAVSWCHYYAASGSLVEGAGDVSEDTELDGTTFLFITTQQNF

SEQ ID NO: 1489 - protein, 139 aa, Homo sapiens
SSFAWRGYKLMSSFGRLGWAFALLGVGGAAVAATRLDIALMRAPPPPSMRLEPMGAAMGAVAVAGGQAVLPMAPAQMCLQLQRLSQRRERSPTELGLATGIPQPEGKKAGGGRLGAGVGDPHLPPGPLRDTILHLLAQC

SEQ ID NO: 1490 - protein, 17 aa, Homo sapiens
GTPTCPPAHFEIQFFIY

SEQ ID NO: 1491 - protein, 32 aa, Homo sapiens
QIMLQHIVLACCWPAGFSIGLAWTRSMKAKWR

SEQ ID NO: 1492 - protein, 68 aa, Homo sapiens
IQHTQIQDDSSCDKQRYHLSDCLCPYRGGYDSLRSVCTRTAKIWCEGWPDKLCCSILYWPAAGPQASQ

SEQ ID NO: 1493 - protein, 127 aa, Homo sapiens
FPPTRCHLSSRQRSTASCMFLLRTVRTPPPVTSRLGLCLPLPHPQFCSLLCPGELPSSTTATHVAKPSPHRVPCRFTRELTLERNPLLALFVEELSRLKAILRYTWALTCGIAPLHDGVGGSLWMAP

SEQ ID NO: 1494 - protein, 23 aa, Homo sapiens
MKIQPPHPKPSPPAPLLIILMNK

SEQ ID NO: 1495 - protein, 94 aa, Homo sapiens
CRGASRPSPSTSTPRSRGLRAGSVRRWPRRWRGSRLQNLMMMFQKQTASPLKALTLRRPLSSLFPQRQGNKWPPLERGRSTVATQVATSKLSMA

SEQ ID NO: 1496 - protein, 91 aa, Homo sapiens
GSTRTSGPSNARSAPTPAATPASSLSTCDPTRLQNLMMMFQKQTASPLKALTLRRPLSSLFPQRQGNKWPPLERGRSTVATQVATSKLSMA

SEQ ID NO: 1497 - protein, 158 aa, Homo sapiens
ELGRDRSPVSDRPQQAARHAPHCGTPPGAPPAQPSAPVQRGKSQNHRWASGAPGEHHRPGCRRCSEHRPACLGGPEPRGTPREQPAADPAPGQSDRPPSVLAVSERGGRNDPAGCPADHPRADGRSHSAPDSHPHGLRWPPGRLWQSNFHYQFGYYLH

SEQ ID NO: 1498 - protein, 139 aa, Homo sapiens
FILERTLTTVMNLVRLLSKVQNLQDITEILLGRNHTNVVNVVELLVIKQVWCTIREDILERCHTNVLNVGKSLTPLQPWQGIGEFILERNLTNVMNVARSSVIAQASHVIGVFILERNLTNVMSVAKPLEYVQFCLIIR

SEQ ID NO: 1499 - protein, 211 aa, Homo sapiens
FILERTLTTVMNLVRLLSKVQNLQDITEILLGRNHTNVVNVVELLVIKQVWCTIREDILERCHTNVLNVGKSLTPLQPWQGIGEFILERNLTNVMNVARSSVIAQASHVIGVFILERNLTNVMSVAKPLEFPERVNRRQRHVSYKACKITESRSVAQAGVQRRDLSSLQAPPLGFLPFSCLSLPSRWDYRRPPPRLANFFCIFSRDRVSPC

SEQ ID NO: 1500 - protein, 87 aa, Homo sapiens
ITGEVTLETNPTYVMNVASPLVKVPTLQFIREFILERNLTNVIDVGSALVKVPLLQLIRQFILETNPTNVMNVAKPLNGTQASLHII

SEQ ID NO: 1501 - protein, 78 aa, Homo sapiens
FILERHLTNVMNVARSSFNVHVLQGTGEFILERNPTNVMNVARSSVNIHILQCIREFILERNLTNVMNVAKPLIGAHY

SEQ ID NO: 1502 - protein, 38 aa, Homo sapiens
PANVKNVAKPSTGPHTLLHIREFILERNGTNVKIVAKN

SEQ ID NO: 1503 - protein, 38 aa, Homo sapiens
SIPLPLLHIREFILERNPTSVINVAEHLFHPRSFMYIR

SEQ ID NO: 1504 - protein, 34 aa, Homo sapiens
SFVHIREFILERNPTSVINVAKHLFHPHSFINIR

SEQ ID NO: 1505 - protein, 27 aa, Homo sapiens
DKRYWKKTFQMYRMWQSFQPVLNPCYT

SEQ ID NO: 1506 - protein, 27 aa, Homo sapiens
SIPLPLLHIREFILERNGTNVKIVAKN

SEQ ID NO: 1507 - protein, 23 aa, Homo sapiens
KKVVKVWMRVKYTKEVIMDLTNV

SEQ ID NO: 1508 - protein, 55 aa, Homo sapiens
SLWTASLKKKKRCSPSCPMRKKVPQETRRCPRLPGVASLRLQRSLLEIRKQRQHL

SEQ ID NO: 1509 - protein, 50 aa, Homo sapiens
NLNKAHTQKVRTCLKKTESQMASPESQLKKYRRASYPSTKFLLEKNSRRP

SEQ ID NO: 1510 - protein, 36 aa, Homo sapiens
GKSVSAGLSRKISPSILQWFPGLSRKATRLVLKVEF

SEQ ID NO: 1511 - protein, 33 aa, Homo sapiens
NQSNTCGKSKFFNFSELHVIKKMGYQRRKKCHN

SEQ ID NO: 1512 - protein, 31 aa, Homo sapiens
KSMLKKSLRKKGNTANGPGIGRKSLMPMQVT

SEQ ID NO: 1513 - protein, 15 aa, Homo sapiens
KNGLPETEKMPQLMP

SEQ ID NO: 1514 - protein, 14 aa, Homo sapiens
KNTGEQATRLPSFC

SEQ ID NO: 1515 - protein, 13 aa, Homo sapiens
KMELTSTFAIRMG

SEQ ID NO: 1516 - protein, 50 aa, Homo sapiens
WRCKKSLLKRNMKSSWMFAKIFNQFSVTSAWKNSWIQLFGLRSDWLIRAV

SEQ ID NO: 1517 - protein, 49 aa, Homo sapiens
RIKFQIFGLFFQGYSVCETRKELFRSKSYLSSSYYLPQDFGCQLSNSSV

SEQ ID NO: 1518 - protein, 43 aa, Homo sapiens
KKSLLNYFNCKFISIIRKEPKPKKKVLMNQQNGEVFYTTYMIC

SEQ ID NO: 1519 - protein, 37 aa, Homo sapiens
EHKGCSRTVSYSNWSILASNKGEEIYILCKNGPSKLP

SEQ ID NO: 1520 - protein, 37 aa, Homo sapiens
ILFLTMLFLRICVLLSKKSNTVEDPFHSWRKLTIFSQ

SEQ ID NO: 1521 - protein, 29 aa, Homo sapiens
CLYYISKLRCHSVEDSEKRHKYSSRPANY

SEQ ID NO: 1522 - protein, 23 aa, Homo sapiens
IFSKACQNVNTTKKIKKNFHSQK

SEQ ID NO: 1523 - protein, 23 aa, Homo sapiens
IPNFWTFFPRLFSVRDKKRALQV

SEQ ID NO: 1524 - protein, 19 aa, Homo sapiens
IGMLFLDFYRNIFRKKQNV

SEQ ID NO: 1525 - protein, 300 aa, Homo sapiens
AWAAIPPRPAAASPRHPGPRPPTGTSPRSPGRGSRSRTLGTPRAQTRPRLSRTGPKSPRAAAAAVVAAVAAAAAAAAAARRQKGRRKATRTGTGAAAPGAVTAALPAPGRPHRPPPPPPHPPPPPPPPPHPPLPPPPLPPPPLPLRLPPLPPPPLPRPHPPPPPPLPPLLPPPQTRTLPAARTMRQPPPPRLALPRRRRSPPRPPSRPARRGPRPTPQARRRPRPSPRRLLRSPHSLCSPRLRPGPRADPRRERASTSPPPRSWPSGSACRPWRTGPRSPPSCQPGSSGSGSASPPSGVA

SEQ ID NO: 1526 - protein, 52 aa, Homo sapiens
SCSAAGTPRTGARNPIEAWHAEALAGRGNGPTPRAPCRPPAREGRAATVAES

SEQ ID NO: 1527 - protein, 136 aa, Homo sapiens
PWSRAAPQVPRRAPQSLWTSEPRPPRRARHRRSPVPHHPPSPAAQHPSHLQSCQLLPPPWPQHPSSPCLPHAPSPRRRGQPRSRVPRALGGRGRRPSCLSNWTTRVSRHPKARRLKRPCCSGRIRGRGAGRSPRAS

SEQ ID NO: 1528 - protein, 39 aa, Homo sapiens
ERDTRGLRRNMMPSSEWGKPGGGTRLGMNMRPRRTSSVS

SEQ ID NO: 1529 - protein, 228 aa, Homo sapiens
GSPRPHGWPFRAGGAPHQGHQAGRQGAALGPLPRQEDARAPAPGASSAAHTASAAQGSGRGQEPTQEERGRPPPHHQGAGQAAAPAVRGEPAQDRRLPASPAALEVVRQAHPAAWHEGQGPQALLQGHRARQGDDPYRGLCRVPLCRPPQPALHRPHPEHVGVVGQQHGGPRQVVLPPRGDQPGQAVPPGPALGPEVQPQPPGGPAGLQPEEGLHGARAIPVLACGRK

SEQ ID NO: 1530 - protein, 92 aa, Homo sapiens
RGARRWRAQVAGLPTPQPIWPRTPGCPARATHPCGSLDTPTAWVPHLCTRAWPLRSHLAWGAPSRQPTSLSGTPNRASWWSFPVITFLTLRS

SEQ ID NO: 1531 - protein, 71 aa, Homo sapiens
RGPAAPGGSGGGGLAGAQEPPEPGQLSPRGRQQRAQGTLAQGHRRGPRPGARAGAHVRGLWEPQEPRQGPG

SEQ ID NO: 1532 - protein, 437 aa, Homo sapiens
SAMGKCSFIGNTHVLLSIREFIMDRNHMSVSNVRSPLVILQNSWYIKQFILVRNLINVKSLGRHLAILQTLESIRKLMLVRNLMNVKNVGRSSVILQTLLNMGKFMLRNPMNVKSVGKLLGLAVNLLYIIDFIMVRNPTNVRNVARPLVCMDDLVDIRVFTLVRSPLNVTNVGSPLGSKQALKYIRVFILERSHMNVRNVERPFVSFPTLWVIKEFILEKNPMNARNAGRALHVGINLPCIREFIQGRNTMNVKKMGRLLVVAINLLHLIHLKVLRNLISVRNVGKPLVCMDDLLDIRVFIVVRNPMNVTNVGSPLGSIHPLKYIKIFIPVRNPTNVRNVGRPSVSVHTLPIITEFILVTNPLNVKNVGSPFVVPHILLYMREFIQERNPMYVKSVGRVLVIAINSLYIAEFILVRNLMNVRNVGRPLVYLDNLLSI

SEQ ID NO: 1533 - protein, 198 aa, Homo sapiens
VFTVVRNPLNATNAGSLLGSFLYLKPIRIFIALRNPTNVRNVARPFVMPQASYIMTELMLVKSPMNVKNVGKLLVMLHILLFMREFIPVINPMNVKDVGRHFTVPHILLDMKAFMLMEIPICVKSVGKLLIVAMNLVYIIEFILVRNPLNVTNAEGPLGLDPSLKYIREFIFDREIVAYTGSKESTLCQWIYPTEQFE

SEQ ID NO: 1534 - protein, 59 aa, Homo sapiens
TSSATWILQIRNARVRTRPMTSLKAPRKSLNSNSLRSNSPLSLKPFAPELKQGRRLCKW

SEQ ID NO: 1535 - protein, 57 aa, Homo sapiens
ETRQGAPNCLTVLNHPVWVTRSSIYQRRPLILWKPCLRGMLQPLFPEAAGLVRAFLW

SEQ ID NO: 1536 - protein, 133 aa, Homo sapiens
SQYQIWRCRQPQAHCQGEMPQWTRWNFQKILQIRNRTWKSWGESRPLLLRHLLVEATCQDRDSPPRGQAMWSTPAERRTSPLRQAVKMLDQAHRPELQNIQQRSLLQPGPHPHRLSPPPPQRMRRKKKKKETK

SEQ ID NO: 1537 - protein, 132 aa, Homo sapiens
SQYQIWRCRQPQAHCQGEMPQWTRWNFQILQIRNRTWKSWGESRPLLLRHLLVEATCQDRDSPPRGQAMWSTPAERRTSPLRQAVKMLDQAHRPELQNIQQRSLLQPGPHPHRLSPPPPQRMRRKKKKKETK

SEQ ID NO: 1538 - protein, 44 aa, Homo sapiens
IQTVMLSHPGLTVTLKTLGRAPQCHPRRRRAPAGPHRRAGCLSP

SEQ ID NO: 1539 - protein, 127 aa, Homo sapiens
WAPERHGRSPSRTVHGYGKGHSRRSPEESGGGSPHLRPALPQHRCPWRCEVGSGAFVRHDGSPRAELPCGHPALPALRGPAEPCSELASRGQLPSRPPGSNLHSADVAGSAVPTDTHEWVCHAELVH

SEQ ID NO: 1540 - protein, 36 aa, Homo sapiens
TCTLTIMPTAPLTPCSQTGPLRAARPLKRSQAPWCI

SEQ ID NO: 1541 - protein, 35 aa, Homo sapiens
LPKPLSRFFPVGRCMILLAKREKTYRRLISMPEKR

SEQ ID NO: 1542 - protein, 29 aa, Homo sapiens
YLMFFQQRFCCKFIPHSPRGLSPTLASSG

SEQ ID NO: 1543 - protein, 26 aa, Homo sapiens
SPLRRYLQLHVRAPAGPHRRAGCLSP

SEQ ID NO: 1544 - protein, 24 aa, Homo sapiens
GGPEVPRKYWECKHLRWIGREKRS

SEQ ID NO: 1545 - protein, 19 aa, Homo sapiens
WQNSRAPAGPHRRAGCLSP

SEQ ID NO: 1546 - protein, 13 aa, Homo sapiens
CKHLRWIGREKRS

SEQ ID NO: 1547 - protein, 70 aa, Homo sapiens
IQTVMLSHPGLTVTLKTLGRAPQCHPRRRRIWNFSMKMYGNLMLNMKMAPKWNSKRAPAGPHRRAGCLSP

SEQ ID NO: 1548 - protein, 70 aa, Homo sapiens
KGARHLGVYRKATERCRIIQPCRPRPSSNGEASFCLQHGDNTQRQRDQREDASHGETDCQFNWPCSVCAF

SEQ ID NO: 1549 - protein, 60 aa, Homo sapiens
WKVMQSKPLWRSPKLLLKERRERLTRDAGKGARKKMPATYPRTRRMGVRWSRMSTAVYRW

SEQ ID NO: 1550 - protein, 46 aa, Homo sapiens
RGKMEEKRRRVNVEEKERCALRKKIPLTVKMLNQIWTTMRMRRSLP

SEQ ID NO: 1551 - protein, 42 aa, Homo sapiens
NKGNFHPRKILVGKKTQTISHQPKKQRKPKRANCVIQRRAKM

SEQ ID NO: 1552 - protein, 31 aa, Homo sapiens
KKSQMLSPQRERKRRPSQLPQMPPTETSRPR

SEQ ID NO: 1553 - protein, 22 aa, Homo sapiens
GITLTHTQVLVLTSAQTATWPL

SEQ ID NO: 1554 - protein, 93 aa, Homo sapiens
HTHRYSSSQVPRLRHGLCDQWRIGSASSLQTHPREAIQVFHVRLRQCRSQQIKTSHSLSYWRASVSVQFVQLCQQGHIQAEKAHENPFRGKAL

SEQ ID NO: 1555 - protein, 21 aa, Homo sapiens
SGGQWRGGDTRTRGTSTPGRS

SEQ ID NO: 1556 - protein, 63 aa, Homo sapiens
PEKVIWVSTCESSIPILSKARNAVTVMLCFMSAMPSSSIRSHTRMRSALSVTSVITLVDRRGT

SEQ ID NO: 1557 - protein, 46 aa, Homo sapiens
MSSPWMMIPLCSSLTTALACARPALRATMPPGLSSLPSWGAPGSRA

SEQ ID NO: 1558 - protein, 34 aa, Homo sapiens
WPKHCSYMVLISNQKTSMASHHCYLVYMSKNSKS

SEQ ID NO: 1559 - protein, 21 aa, Homo sapiens
WGACIRKSPMWARRPRAKEAS

SEQ ID NO: 1560 - protein, 74 aa, Homo sapiens
RHSGTRWASGAATASPAAGGAARARWALGETTMTVPSWSPGTTSVEKIWTSSTELPGGVKSPERISSSCSGTLT

SEQ ID NO: 1561 - protein, 69 aa, Homo sapiens
QRLWHVQGRLCGRRCPPGCLPFHRGAPQAAGHDGGHASERVLCGQGGPEQKRHPDPEVPHGTRHHHQLG

SEQ ID NO: 1562 - protein, 59 aa, Homo sapiens
TPRKELEQPGGRPGPWGLVGMWRAQPGGSQSPGGSMGGHFQGVQGELGAARGLGGEAHS

SEQ ID NO: 1563 - protein, 40 aa, Homo sapiens
RPICSTSRRDGCRSWTSLESLPPPRSPPPLLRSGRNIGLC

SEQ ID NO: 1564 - protein, 32 aa, Homo sapiens
TAPPRASLYTTCCVHWTPRCPPGVLAPPPHPI

SEQ ID NO: 1565 - protein, 631 aa, Homo sapiens
HHTVDLEAPRLRLLLPKGTLLRLPLHVKSPEPPLPIESPKGTPPGPHPPNRKSPGPHPPNRKPPGPHPPKRTPLGPHPPKRTPPGPHLHSGTPPELPLPHEAPNWITPEPLLPSRTTPKLLFLLVLPSGKTPGHPVSSRTIPEPPLPTEPLNERIPEHPVPSGTIPKPPEPPLPIEPHETTPEHPAPSGTIPEPPLPVELHETTPQHPVPSGTIPEPPEPPLPIEPHETTPEHPVPSGTIPEPPLPVELHETTPQHPVPSGTIPEPPEPPLPIEPHETTPEHPAPSGTIPEPPLPIELHETTPQHPVPSGTIPEPPEPPLPIEPHETTPEHPVPSGTIPEPPLPIELHETTPQHPVPSGTIPEPPEPPLPIEPHEITPEHPVPSGTIPEPPLPTEPPNKTAPEHPVPDGTIPEPPLLTEPSNKRTPEHPVPYGTIPEPPLPAEPSNKRTPEHPVPNGTIPEPPLLTEPPNKRTPEHPVPDGTIPEPPLATEPSSETTPEHPVPSGTIPEPPLLTEPSNKRTSEHPVPDRTIPGPPLPIEPHETTPEHPVPSGTISEPPLPSEPPNRTTPELVFNRTSPDHLLPNKTTLKPLVPNEITSDPLVHSGTAHSPFPFNETTLEPPHLNAAPKRRI

SEQ ID NO: 1566 - protein, 207 aa, Homo sapiens
PLLSPPSLHVLCALGTGMPLEPLRPLAICSTTPSPSSQSPAPLRVNRPTTSLPIYHLLCALDTEMPPGRPRPPATPNLTPSPSSQTHQMPSISVSPPNTSPFSSLHLCVLGTEMHPGPPPHHARPQSLPSYSRTSPGPAQRALSLPWTLCTSAPTSPPLCALGTGMHPPSHPHHARLLSHPSSSRIPLELVWRAWPPPLTLCMAPQC

SEQ ID NO: 1567 - protein, 77 aa, Homo sapiens
PGGAKQSPLILGVLRRDLREIGSSRGPRCPPGHQPGPLRGSCGHRDLWRVAKQAQDSLWGCGRVRRNRQGPRALIDT

SEQ ID NO: 1568 - protein, 66 aa, Homo sapiens
PHGGCPGTGPRCSIRSCCLWGSSGGEGPICSTSRRDGCRSWTSLESLPPPRSPPPLLRSGRNIGLC

SEQ ID NO: 1569 - protein, 62 aa, Homo sapiens
KGAGAARREAWALGAGGDVESPAWGQPKPRREHGGALPGSTRRAGGSQRPGRRSPLMSSPEN

SEQ ID NO: 1570 - protein, 56 aa, Homo sapiens
ILTVAQILSFLYLQKVVQCLSSLHQQIVGLILFFPNWKIIQIIIPHRLKETLIPPF

SEQ ID NO: 1571 - protein, 43 aa, Homo sapiens
GQVKQKKMVYTNVIVKAVTVYMQPGRISSDTFLISIMTNIRLI

SEQ ID NO: 1572 - protein, 27 aa, Homo sapiens
RELIRKKMSHKIKKGKLKKLNQHQQLS

SEQ ID NO: 1573 - protein, 88 aa, Homo sapiens
PTERSIKSLEQNVCFLNVEEFFRKLIYYMIMKHNIIIRTLVSSQVVVKFIVLRVSWKSIWMITVLLLKKCCLLKPNLIHLEIPFSLLK

SEQ ID NO: 1574 - protein, 16 aa, Homo sapiens
QNRKFFTSDYSYFRTM

SEQ ID NO: 1575 - protein, 14 aa, Homo sapiens
QRVLKSQLLTFIQM

SEQ ID NO: 1576 - protein, 13 aa, Homo sapiens
RGVMVKMQFFLHK

SEQ ID NO: 1577 - protein, 69 aa, Homo sapiens
WKVCLFFAITGEQLKSIFYITDQSQWESCLFGPVAACLATHFSSSFSKCVNSIVVLNGKCHKSKYNFSG

SEQ ID NO: 1578 - protein, 55 aa, Homo sapiens
LQCTSQTSPWRKPLETIIQIFWKSEMEAMKNHHCWEYSMAQIYPQQSSLIVTNYG

SEQ ID NO: 1579 - protein, 53 aa, Homo sapiens
KSFFSRMDPGHMAASLLPIPPVKMQCVVGLFQILLKETLLLLAMTESGITQET

SEQ ID NO: 1580 - protein, 48 aa, Homo sapiens
VVVEYFILIMVQSDPLTGLRIFPKTADVPGRPLLTKVNTWRSALTTTS

SEQ ID NO: 1581 - protein, 23 aa, Homo sapiens
FTSPSIHLLWRQQVLGKDAFMIM

SEQ ID NO: 1582 - protein, 86 aa, Homo sapiens
KGVQLVCLKIYLVKSISLIPSWWILRENSKACSRLLTKRFAAAILARMVEPASICMIPFFVSVPHSGRVLSAQLMLTNVRFTQEHP

SEQ ID NO: 1583 - protein, 17 aa, Homo sapiens
FLFLYLSPTVEGSSLLS

SEQ ID NO: 1584 - protein, 77 aa, Homo sapiens
LEKGSFARLFFLTCILEKEPVGGPSTSPKAKSFSSTSLSLKLEVLPTVKQIMLRLVAVPFWVLLKIKSIAVQTYLHL

SEQ ID NO: 1585 - protein, 150 aa, Homo sapiens
GATAAAAPRVSPSTPSGPSVWMRMSVPCRPPPAGAPPVATLLVASAASAPLALTLIRPSGAARRWMSAPDGVAPVATAVPTRLVASCAAVLKATSGLGKGTVSPAWASAPDPRTPRTKRSCSRLKPATNARSMASPLGTGHDAVPTGTTR

SEQ ID NO: 1586 - protein, 208 aa, Homo sapiens
TLTSASMGTARTRRVPLSATVSWATWSGRGPQAALMWMNARLEDTTVTVTPPVSTSRGVSAVGACQAGWGMASNVTTWMNASPRSTGAAQEVTVSMSLAPTAAPAARALPGMASSAKTGMNVPRTWTSVTTGSASMRPAGTAVNVRWALTPPRTTGPARMWTSVRKGTSVHLGAVRTCLECSAASAMVATNWTEGVATAQTSTSVQTQ

SEQ ID NO: 1587 - protein, 206 aa, Homo sapiens
HTMGIVWILMSVLPWWGRCADLAIASTQLVPSTASARMALSSQLMGRTVWTPMSASALQEPAYPALARTSRAPSAASVPLASRCRVTTALISTSAQRSPTSASLAPVPTALGASSASAHLALSSLTMGTVALTHGRVSASPVLRLGSARCPKLSTPPRPAAAAVRGLGRAGETPANCVPRRAALPFRSSAPLATGQSQARMTPEKT

SEQ ID NO: 1588 - protein, 90 aa, Homo sapiens
RVPDARHLRERPLYQHRGLLPLPVPGGAGGRHGWPRVRGHPRAQHLLWGHREGLLCPPLPWHCHQVRVLLCQSGPRFWGALPALSCQRLR

SEQ ID NO: 1589 - protein, 171 aa, Homo sapiens
ARMAACAWTPTCAAPAMGPSRRAPVPAPSLALSPSPSAAVPIRTTVLGSPASFVLPKTPLSSRHCAAVGLALPRMVETSTSVLWILRFVPMACARTFGAATAVSATWVMRQVPQARTAQTWMSVPSTASCVTTGGARIALAATAAPAPPASTSGRTRRSAKMSTNACPARV

SEQ ID NO: 1590 - protein, 170 aa, Homo sapiens
TPAEWAAWTLGPGTVSWRRMTEGTVAFPAVPRSELVSPELPAVAPWAGLGAIPVSCALWPTPLSTEPCARVVRASSLTASLSFWKTSTSAKSCQGCVRGVTASTRLAVSSVSAHLATTSVSTPASVRILTNAPHTPASVALAPATTPWGTTPVSALQSTSKSMVATTAWI

SEQ ID NO: 1591 - protein, 136 aa, Homo sapiens
GPVMSPLPGAGVIPAGTNGRLRQSMQSSLLCLPGRNFPMVARRPPNRARKLKAYEKDPCWDPAKRQPPSLLLLVFASSGRVRRSRRCTGSPQTPPRDANLPKTSRLSLSQAFLTLRRKWWPTQSSRPRRTARLQTG

SEQ ID NO: 1592 - protein, 105 aa, Homo sapiens
MPSPWPSLAWTTVPPSTSWLLSQKNRGCQRSTGALPRIHNMSKAALRVGPAWTRTDTQARTSQRGTKRNPIRWIPRKREDAKKTTGENWRPSASGKRRKQPRRDA

SEQ ID NO: 1593 - protein, 19 aa, Homo sapiens
AKKTEGVKEAQAPCPGSTT

SEQ ID NO: 1594 - protein, 178 aa, Homo sapiens
KHTKKTHAGTQRRDSPPASSCWCSRAREGSGEVGDAPGARRHHRGMQICQRPPVFPCPKPSLPSAESGGPHRVHDLVGQRDCKRDSKARPCDARWRGKSLTVWNKIEKDQLFLALQLRPTGRTEEEEEAQQHRRQRGCRAACSGERSWRERDGGCGPQAWSIPPPRAEASPFHPEGLR

SEQ ID NO: 1595 - protein, 65 aa, Homo sapiens
ARSRTPRASPSWAWRRRSTRKPQLGRTLPEAPATRGRAAGRLSPARSLPAARPHSQNGLPFGPES

SEQ ID NO: 1596 - protein, 258 aa, Homo sapiens
CRRRCLPRNRCSRSCRPRSCRPCSSSSKPSCSSSYRSTTRSSRSSSTCSSSPSSRLGNRSPKRHWGTSSWPSSSSSCKCNSCSSSTCSTCRGRGWSACSPTKPRGPSRPFRKQLFAQQTCPSCGRARVPPGSLPRTASSRRGWTSLARPPPLPRLPLPPRSHPPSPTIPCPTDSLLCSHLGETALPTRRPPAPTPCTDTESASGQAVRPCVKTWASLSNTSTQSTPWMTGVQPSAGYRCRWCSSWRSSSPRRASGCRP

SEQ ID NO: 1597 - protein, 257 aa, Homo sapiens
CRRRCLPRNRCSRSCRPRSCRPCSSSSKPSCSSSYRSTTRSSRSSSTCSSSPSSRLGNRSPKRHWGTSSWPSSSSSCKCNSCSSSTCSTCRGRGWSACSPTKPRGPSRPFRKLFAQQTCPSCGRARVPPGSLPRTASSRRGWTSLARPPPLPRLPLPPRSHPPSPTIPCPTDSLLCSHLGETALPTRRPPAPTPCTDTESASGQAVRPCVKTWASLSNTSTQSTPWMTGVQPSAGYRCRWCSSWRSSSPRRASGCRP

SEQ ID NO: 1598 - protein, 256 aa, Homo sapiens
CRRRCLPRNRCSRSCRPRSCRPCSSSSKPSCSSRSTTRSSRSSSTCSSSPSSRLGNRSPKRHWGTSSWPSSSSSCKCNSCSSSTCSTCRGRGWSACSPTKPRGPSRPFRKQLFAQQTCPSCGRARVPPGSLPRTASSRRGWTSLARPPPLPRLPLPPRSHPPSPTIPCPTDSLLCSHLGETALPTRRPPAPTPCTDTESASGQAVRPCVKTWASLSNTSTQSTPWMTGVQPSAGYRCRWCSSWRSSSPRRASGCRP

SEQ ID NO: 1599 - protein, 107 aa, Homo sapiens
PEYSPVPGTDAGGAAAGDPARQGERAAAGHDGPPAHAALGAQALQPATEPGPRLLLILQGDRLCSRLIPRWSRAPPDLGRSPCHPSTAPWPGLCLPAWWGPSPSEKQ

SEQ ID NO: 1600 - protein, 223 aa, Homo sapiens
QQTVCLCCAGACVGGHDVAADAYPATDAADPVAPAAAGLAPAAASPHAPAATGVLQEAAGAAPPAAPHPAAGWETAAQRGTGEQAAGLPAAAPANATVAAAAPAQPAEAGAGQPAAQPSLGAPPDPSASSCLPNRPAPAVEGRGCPRAACRGQRQAGGAGPHWHGRHRYLVCRSPQGLTPPLPPYPAQRTAYCAHISERQLFPRGDPRLPPPVRTRRVQVARL

SEQ ID NO: 1601 - protein, 222 aa, Homo sapiens
QQTVCLCCAGACVGGHDVAADAYPATDAADPVAPAAAGLAPAAASPHAPAATGVLQEAAGAAPPAAPHPAAGWETAAQRGTGEQAAGLPAAAPANATVAAAAPAQPAEAGAGQPAAQPSLGAPPDPSASCLPNRPAPAVEGRGCPRAACRGQRQAGGAGPHWHGRHRYLVCRSPQGLTPPLPPYPAQRTAYCAHISERQLFPRGDPRLPPPVRTRRVQVARL

SEQ ID NO: 1602 - protein, 221 aa, Homo sapiens
QQTVCLCCAGACVGGHDVAADAYPATDAADPVAPAAAGLAPAAASPHAPAGVLQEAAGAAPPAAPHPAAGWETAAQRGTGEQAAGLPAAAPANATVAAAAPAQPAEAGAGQPAAQPSLGAPPDPSASSCLPNRPAPAVEGRGCPRAACRGQRQAGGAGPHWHGRHRYLVCRSPQGLTPPLPPYPAQRTAYCAHISERQLFPRGDPRLPPPVRTRRVQVARL

SEQ ID NO: 1603 - protein, 95 aa, Homo sapiens
PEYSPVPGTDAGGAAAGDPARQGERAAAGHDGPPAHAALGAQALQPASDRLCSRLIPRWSRAPPDLGRSPCHPSTAPWPGLCLPAWWGPSPSEKQ

SEQ ID NO: 1604 - protein, 91 aa, Homo sapiens
PSLQQTHSQMVSCTPRPRPQPLSPLYGPLAWALPPCMVGAQPVGEAVTSSAPPSPQSWPRIMSSTRTPTSGPPSPTPPSSARPSWKPLTGS

SEQ ID NO: 1605 - protein, 47 aa, Homo sapiens
PTPGVPWMAVLMPRCSGLPGRPPRHPLQSLHHPPCSLSAATQAIPPR

SEQ ID NO: 1606 - protein, 213 aa, Homo sapiens
VLARPCPLFPRQAPERPLSCRREVGLSLWPLAQSLRPSLPARPVTGLRKGVQGATQMAPVLGALCPPHFLASATPPGKALEAPPTAQMGLPSLLCLPRCPGLWPAQSRLRAHLHLLSPWLPPMTPMALASPHFLRNATCPGRGNSQDPGAQSRHHRQPEASVTMSPSHLCSQIMSPKPQSLLHKRAKAMSSLSRIHPSSGTSHTCPVTKPLPC

SEQ ID NO: 1607 - protein, 190 aa, Homo sapiens
MTKSSPLWAEAPTSECIQAIGLASAATAPAARATGSPAGFPMGATTGQREPWRGGDWPTGAMRDPPRATPRPRWRRGASADRCQRGYTPTHLRWGNQPLGTLATAPQATGRWSSWRTLGCLPYTHAQPARRSWRCLQQPCMDCGWRGRLEKGGQVRLASLSCTQCGLGTRCLCSCLPVGITMPRCLTTAA

SEQ ID NO: 1608 - protein, 53 aa, Homo sapiens
LPSASWQLPSCSAPWLPALSTSSASVSSSAKKTLHSPSPTAGRAWSLPCPLAR

SEQ ID NO: 1609 - protein, 40 aa, Homo sapiens
RTPPISRCYQAGSTGRRPAGSYLSPVLPQGTPFLSSLGER

SEQ ID NO: 1610 - protein, 26 aa, Homo sapiens
ALGPARIPLRGAGDPSDDVPPPAATL

SEQ ID NO: 1611 - protein, 98 aa, Homo sapiens
SGSSSGSPSLSSSSLATTRRTWTLSMQAGPVFMIRHLCGWNKFALRTRAGMSAKCSCWTSSMTPSTMAAGSTSPSTPLPPLQKHPPSTSRPRRVVVSP

SEQ ID NO: 1612 - protein, 88 aa, Homo sapiens
CARESAAQGRPPPRTAPHLPAGARGLPGHPVSGGTEGLGRQVARQGPCPSAPRRQVAGQTYATSGKPRAAATYKPRHGHTCAALPRAG

SEQ ID NO: 1613 - protein, 80 aa, Homo sapiens
HRSVGRTEVPTPAERTAFRGRLSTRLTCLSKGPLSSSPLLRTSPSTSPRMLCSPAGQRRIRATSPTPGTGRTRTSTFRTT

SEQ ID NO: 1614 - protein, 74 aa, Homo sapiens
CSPTSCHPVMCPRVCSPRPASPEDCPPPPCRCPRPTRASCLWRHRRVGQASRPAGALSQRPPPPSGRTDLCNLW

SEQ ID NO: 1615 - protein, 42 aa, Homo sapiens
KAQGGQEEENPPGSCAGCGLHLGDRAEEEQPSREEWEGPTAG

SEQ ID NO: 1616 - protein, 37 aa, Homo sapiens
SQPPRNGDLYCVPHQGAGGHRDCGPEFWEHPCFRGLW

SEQ ID NO: 1617 - protein, 35 aa, Homo sapiens
VQAKKRALLCLIALLSRKQTWKIRTCLRRVRQKCF

SEQ ID NO: 1618 - protein, 82 aa, Homo sapiens
RRVSQRAWWMLRPMQPTSRTLQRPPRGALEAGGRRNCQDQVAHPNWNTQSVQTPRVRRTLGAPVPPSRKVKAWAPGTDQWPG

SEQ ID NO: 1619 - protein, 79 aa, Homo sapiens
RTLTASSRSWMLLQQGLRLPRRGTVALRRAVLRATHQPGLEVGAPAVPNQSRGARPPPRGGPGLLVPPPTHNGPPSLRF

SEQ ID NO: 1620 - protein, 42 aa, Homo sapiens
TMSSKPPGGDPTPARRTKKQSSATYVSLVSSAISLLVNSWRD

SEQ ID NO: 1621 - protein, 29 aa, Homo sapiens
ASTGGCSTQLGIPSTASTLNATMQLTNQL

SEQ ID NO: 1622 - protein, 26 aa, Homo sapiens
TKAMTAPPVKMLPLLPPSPAIPPSSA

SEQ ID NO: 1623 - protein, 19 aa, Homo sapiens
EKKAFRKKSYALSNKNLLI

SEQ ID NO: 1624 - protein, 56 aa, Homo sapiens
TLNTYLLNTREPIMQKSLMCAIYVGNHSSINKHSLGTSREFTLEKGLMCASNVGNP

SEQ ID NO: 1625 - protein, 322 aa, Homo sapiens
APNTHLWNTREPIMEKSLMCAMYVGNHSATNKHLLAISRESTLERGLMCVWNVGNLLFIPMTAFDTREFTLEKGLISAVNVGNPSYTNSHFLITIESTREKGLMSAKNVGRPSFTKKDFLSTREFILEKSLMCASYVGNHLSARLTTCDTREFTLEKGLMNAVTVGKPSSPNKHFLSITKSTLEKGLMNAVNVEKASTLRLNFFSTKESILENNFVSAMNVEKSSATKKDFLSTRKFTLAKSPVSAVNVGNALDTAPASFNTRKFTVERGLITALHVRRPLSIKTNLLSISESTPEKSRMNVVNVGKPSTKDIPLSGTRRYI

SEQ ID NO: 1626 - protein, 120 aa, Homo sapiens [sequence omitted]

SEQ ID NO: 1627 - protein, 61 aa, Homo sapiens
GLRAPPTSLRREKDGSTSGGSPSGPKSLRPPVWAPPTPSPTTRVWPSRRQPCAHGLWLGSI

SEQ ID NO: 1628 - protein, 111 aa, Homo sapiens
WEPAEEPAAHGDLKEGTPRPCPGQCPAQGRWRGQGCARGSSPVPMFCPLTGSYPRLLLPSPQGVPATLPRGPQARLVPPGPPILPAQFPSPSLEELSGPPCTTRQGREPVL

SEQ ID NO: 1629 - protein, 107 aa, Homo sapiens
LTPASRRCAASSGEPRAHSVLIWSHHCHPLPCLSCALGVPHPRPLRTQHASWPWPWLSGLSRWPSNRASRSVGAPHLLPNPPSTARCLWRWAGSPWGPQGVGHLPTP

SEQ ID NO: 1630 - protein, 19 aa, Homo sapiens
RRMPMAPHVASRLPRVSRL

SEQ ID NO: 1631 - protein, 87 aa, Homo sapiens
RWRKPRHAPRAGWGRPRSPQLPRPRPHLRKGGKGREGRSSGSQGAAAGRRSLHWAGAPVSLERSPCPGWGAPVPHRSLQAADPTPSH

SEQ ID NO: 1632 - protein, 191 aa, Homo sapiens
GASGPWGPQGGDSEALPRSVPSSGQVAGAGMRQRQQPSPHVLSPHRFLPPASSPQPPGSACHPSSGSPSQACTPWAPHPSSPVPQPQSGGALWAPLHHSTGERTCTMRSGQVRGPPILAPPAPGVPFAPCPPTGSMPPTACLANHPHSTGPPTSCSATRQPPPAFPLTTLATQPPSTLLGALHRLSPSTST

SEQ ID NO: 1633 - protein, 83 aa, Homo sapiens
WEPAEEPAAHGDLKEGTPRPCPGSYPRLLLPSPQGVPATLPRGPQARLVPPGPPILPAQFPSPSLEELSGPPCTTRQGREPVL

SEQ ID NO: 1634 - protein, 163 aa, Homo sapiens
GASGPWGPQGGDSEALPRFLPPASSPQPPGSACHPSSGSPSQACTPWAPHPSSPVPQPQSGGALWAPLHHSTGERTCTMRSGQVRGPPILAPPAPGVPFAPCPPTGSMPPTACLANHPHSTGPPTSCSATRQPPPAFPLTTLATQPPSTLLGALHRLSPSTST

SEQ ID NO: 1635 - protein, 57 aa, Homo sapiens
KYHSVFYFQFSVPHSGNCLFKRKTLQATLLQKLFFCFFCDFFIYFYIIHHVVSSCLC

SEQ ID NO: 1636 - protein, 49 aa, Homo sapiens
YYHNYCAPCTSCCNDCWYCVCSEKTEKNRYFLYQSSKNKYLWTAQSCLL

SEQ ID NO: 1637 - protein, 23 aa, Homo sapiens
FFYIFLYYSSCCIQLPLLTRFFR

SEQ ID NO: 1638 - protein, 12 aa, Homo sapiens
KKSVFSVSVLKE

SEQ ID NO: 1639 - protein, 68 aa, Homo sapiens
LCSSLFLSMPLCLSQWRSQWIGGENAAYPGPWAVERRHQRQSTCIWRRSSWLIQNGHQNLRQPQKLKL

SEQ ID NO: 1640 - protein, 176 aa, Homo sapiens
TTRGRSHRRHRCHRHRRHSRGGWSQRPREPGRRWPPRESPGPQTAGPAETRHSAETGTPPSPRGRAPRCHDYSWTWDPLRGTASRSKPGSPGSRWRCRRSRSRHSRGRARGGPRGRARTPGRLAGRPAGRERRGRRRRTGRTRTRTRRRTRRRRRRARRRGRGAPGGREQPRCPSW

SEQ ID NO: 1641 - protein, 167 aa, Homo sapiens
QAGEATLLLAAPTPPRTTPRCGQSGAPWPTCPWPPPPRPPPSFWTPSWGRRRPSTPGGGHLPLPPPRRHLLGPPRTRPRPPTPLRPWPVPVQASRRRAPSRGTAATRPRPLFPQREPSQVGGRPRRKGSLGRGLPPSHPTQERPGHLQTRVRSHSRGPGRSRPSWFK

SEQ ID NO: 1642 - protein, 988 aa, Homo sapiens
APLPQRLGPPGPRSARPSGPPGPLRGPPAGVRDLGLPPLPCAPALPSPVLSVRQLPAERLGPRGPGRRGDPGGRPCRGLGGAGDRPVGGRRRGGGGGQLPRGRQQQPWRWPKPPGSPTLSPVQPRGGLLLPATGAGGRRSRLGRPPCSWLPPPPRGRLLAAGRAGLPGRLAHGPPRLGPPRVSGPPHGGGGAPVPRAGATSRSPPPAATSSGPRGPGRVPRPPFGRGQSRFRPLVAGPQAGGQRLRDRDPFFPRGSLPRWGGGRGGRGPSAAGSPRATRPRSAPATSRPGSAPTPGAPGEADLRGSSEHGTAADVPAGGCDKEPPGGEGGDSPGDRTQEGGERPREQRESPGPEQGPDSPGQRETSPKPEPPSERGDSAGERGPESPRHRGEGGGEWGPGVPRERRESAGEWGADTPKEGGESAGEWGAEVPRGRGEGAGEWGPDTPKERGQGVREWGPEIPQEHGEATRDWALESPRALGEDARELGSSPHDRGASPRDLSGESPCTQRSGLLPERRGDSPWPPWPSPQERDAGTRDREESPRDWGGAESPRGWEAGPREWGPSPSGHGDGPRRRPRKRRGRKGRMGRQHEAAATAATAATATGGTAEEAGASAPESQAGGGPRGRARGPRQQGRRRHGTQRRRGPPQAREEGPRDATTILGLGTPSGEQRADQSQALPALAGAAAAHAHAIPGAGPAAAPVGGRGRRGGWRGGRRGGSAGAGGGGRGGRGRGRGGGRGGGGAGRGGGAAGPREGASSPGARRGEQRRRGRGPPAAGAAQVSARGRRARGQRAGEEAQDGLLPRGRDRLPLRPGDANQRAERPGPPRGGHGPVNASSAPDTSPPRHPRRWVSQQRQRLWRQFRVGGGFPPPPPSRPPAVLLPLLRLACAGDPGATRPGPRRPARRPRGELIPRRPDPAAPSEEGLRMESSVDDGATATTADAASGEAPEAGPSPSHSPTMCQTGGPGPPPPSPPDGSPDPPDPLGAK

SEQ ID NO: 1643 - protein, 198 aa, Homo sapiens
AGHQTCPLPHPPRVRQPPAAPGTVAAASTATAASGALASATSARTGHGGSTANDAGPAASATPQALGAAGPASATGTGTHAVATATTSVGSASARTTPRVPTASSAPQAIMGIPGPVVPAFGSVGVAPSSPTCPQWHWAHAGSGGCCLQVAGLQEPGLACPTVCGLSRPLRSYSPVLPGPSVPHSPSPSPPTAAPPAR

SEQ ID NO: 1644 - protein, 184 aa, Homo sapiens
VSGGGHRCWREPRTGAQAHRPAPSMQPHMCPLAVVPCICWGDLPLEASPVISGSSTSPPCNGGRRRPPRPWSCQPLLVTPLLPAEACLCSWWAVTPRKMASTSSCWSTSWQPAPGCQEPRVGHPPQVSMVTLLSTTRPPTPSTCLGGSDSMWSWRPHPPSSTPCTVLTAPGVCWPLLRGQSEIV

SEQ ID NO: 1645 - protein, 78 aa, Homo sapiens
PSGPWTSMSPPPMTPSWSVWPLTLASILYTSSHPQPHHLHHPLQMVGPGGLGIQEEQGPAVGRAPQQSHGYGRYGRGA

SEQ ID NO: 1646 - protein, 171 aa, Homo sapiens
PCPLTPAACCPHLKLVTSLGPAPGAMGPACPGIRPTGWAAGAPPAPQCLAPRRNVDVSGPAVSAWPAILGPCNLEMERRPPPAVSGVPTAPKVLALDAMGPAPLRMTVGSTSERSSGQGTAPRLRAGLLTASSARGRASACGRGSSRGQGRPAASSPCSPPMTGRASATLC

SEQ ID NO: 1647 - protein, 68 aa, Homo sapiens
ALPTCPCDVWPEAVGGCSGDLRAAPWAVLRQLSAPCACGAPIAAGVPGGARMGVAAAWRVDSAAPVMG

SEQ ID NO: 1648 - protein, 52 aa, Homo sapiens
GKSKRMGQWCPCRLVMGKRAQPLSLTHHPQKNPPQPMGPPPECCSSWLRRIE

SEQ ID NO: 1649 - protein, 50 aa, Homo sapiens
AATPAPSWQVLGWRGVKAPRNLGTTSSLPSCPASAPCGLSTSWPSLMLSW

SEQ ID NO: 1650 - protein, 101 aa, Homo sapiens
NWPSPGPSRGTRPARGPAARSKHHCGPCGLRAQGWAGSRNHRDPGWGLRNSPGHRPQLKPRRGIKGQLQPRRPMPRNSVQTRSEQRGHCRPGVQAGVCSPT

SEQ ID NO: 1651 - protein, 68 aa, Homo sapiens
AATPAPSWQVLGWRGVKAPRNLGTTSSLPSCPASAPCGLSTSWPSLMLSCPGTACSRGTWTGPSVWAG

SEQ ID NO: 1652 - protein, 59 aa, Homo sapiens
HPPDPPPFHHPLLLISSPHPSEEPKPKRAKVQAIRGGVRAPECLMDARSFGERKWHHSK

SEQ ID NO: 1653 - protein, 58 aa, Homo sapiens
IWNRTGSETKKEAPRKKGEEDKAAEKGGGRWGAKASGTEVISNSASDLGPGGCGACVL

SEQ ID NO: 1654 - protein, 49 aa, Homo sapiens
GHLLRRRKLKTRRKSQRRTAELGRRWRQRLMPPAQPHHLGSGWSQGRFL

SEQ ID NO: 1655 - protein, 135 aa, Homo sapiens
REAGQEGRRRRSWAVLQWPGRRRLMATRRITRITVRCASRVGKLFCVTPALVPTTSSALILSLTGLQRANGAALTVRRRGSSGRPRRKKKNTKRRERKKGRRRRRMITWSTAAYARTAGSSCAVTRASPPTTFIV

SEQ ID NO: 1656 - protein, 92 aa, Homo sapiens
RRENEDPRSRRRTSQENPENARSVTVRRNLVLSEMSTGRSQRVGAVNMEPDRVGNEEGSTEKKRRRRQSGGKRGREMGGKSKWNRSHQQLCF

SEQ ID NO: 1657 - protein, 91 aa, Homo sapiens
MAVSPMHMPRAEGSSAEDPTLAVGGATCSSASPSTGRWKSRCPTPPSSSRQIRARVLCQVGRTILLALLLGQGASAGNLPFGYVSKLPAEE

SEQ ID NO: 1658 - protein, 86 aa, Homo sapiens
ARASGFASKLTTMMLLRKTKTTSQSTRWVQRRRMKTSMNVLKGVDSQRGSSGMRKISHCLHCWPESGATLRCWASTPVSGRLSSML

SEQ ID NO: 1659 - protein, 53 aa, Homo sapiens
RAPCARLMAQRWMWTWWRMRTALSTSSTRPPSRANTSSVCALVASTCPTAPSK

SEQ ID NO: 1660 - protein, 45 aa, Homo sapiens
DGHTHSQREVQGPARAWEPLPVHRGAPRGRGSPQGPSWGPWPGES

SEQ ID NO: 1661 - protein, 111 aa, Homo sapiens
GKGEPTRSELGALAWRELKLECQPNSVSGPGKLVLEAWPLLSRAPARLRSLLRTARTAPVVWLMWSRSQVTTKSQSSSTRNTFPTAPSWCLWLLRLATPAASLFLAFRSQG

SEQ ID NO: 1662 - protein, 105 aa, Homo sapiens
RLPCGGVGQGQRQWHLQLLLRAQEAGEAHSHGVLGRRQHPQQPLQGECGSWQPPQQGQSIRPRSSQDRAQGPRAHLLHCGLRRGWPGGRQHRHQVCPWSGRPRRS

SEQ ID NO: 1663 - protein, 21 aa, Homo sapiens
HLHGQVHAPGGWQLHHYGPLC

SEQ ID NO: 1664 - protein, 17 aa, Homo sapiens
GPQGRLLWCGLCGPGAR

SEQ ID NO: 1665 - protein, 73 aa, Homo sapiens
DLYGRSWHGRGRGCDPGPHGTEGHGRASAGGPGRQHIPLQLPAHHGGRPHRARHVCRRAHPSQPLHCHCWPSL

SEQ ID NO: 1666 - protein, 36 aa, Homo sapiens
LQPCGVGSSQGGTLRHPRAVPSAAGPLRTPHSHPQA

SEQ ID NO: 1667 - protein, 103 aa, Homo sapiens
SGCRTRKRRSLAPRRTQGGLLVRRRRRQKSAGPQISPRKAQATTSPAGIPWTGRTPRRRQWVPQPTVPVPPVAPRASPHPRATPSSLLPTSAAPAPPDTSGSS

SEQ ID NO: 1668 - protein, 71 aa, Homo sapiens
ARRDMMRSNMMFLVTFKGDSCICMPCAWTAWKGFTRSSASSVSHGGMAAGTSWALCTPTTSWLPLHVVRPA

SEQ ID NO: 1669 - protein, 62 aa, Homo sapiens
RTPSIWSLTRRPWLGAMCSEMPTLITALRGWQFTGGDTSTPPCSSFGGWTSPNSSLTSPGIS

SEQ ID NO: 1670 - protein, 48 aa, Homo sapiens
CCCTHPRVMGGPPKARCPRVGCLHSQLPHPHPTPTSDTPKLPFHPPGN

SEQ ID NO: 1671 - protein, 46 aa, Homo sapiens
MGNTKRRCFSAGRGVTATATTMTSSLTCPMDGTPMKCSSSMRRTTV

SEQ ID NO: 1672 - protein, 34 aa, Homo sapiens
PRLSPDLAEVSSISSLPAAPLPPPGELKIVLAAT

SEQ ID NO: 1673 - protein, 107 aa, Homo sapiens
CCCTHPRVMGGPPKARCPRVGCLHSQLPHPHPTPTSDTPKVSSLARRLDFQEEPMTGFYVGWAEATVAAARGLLLALSFASLRPRSVVIQQPPSPLPPQLSVTPTVS

SEQ ID NO: 1674 - protein, 26 aa, Homo sapiens
QDSSISSLPAAPLPPPGELKIVLAAT

SEQ ID NO: 1675 - protein, 375 aa, Homo sapiens
IHQYPNFSGAPDSFNSLHPGADSRPEWAIQPPVHLLHTSDPHGTSCAGTSDVSISCIQFSAWAAGQVPGSKRLPSSAALGPTPASLSPADDAGRRGCWPASGGCHALFFLHPLQPSAVPRPASHDAAHGPLPLTAGVCPHASEQPTHADVGQPSPGHRVILYPSVPFCRAAYPPSPLCHCSPVLPTPCHTAPCPPAAAGYHAYWKPAAVPACGPQSCPASGGAGPTLGQWTATAESVPPRGPDRHAALSATGTFCPVPSEQLPPASRCVCHPPPAAAPRLHQHGPCYPGPCPNWNHSSPAPSPWGSPPAPGDAAAPTPESWGAPPRRGAPEWGACTLSFHTLTLPLHRTPPSSISSLPAAPLPPPGELKIVLAAT

SEQ ID NO: 1676 - protein, 371 aa, Homo sapiens
IHQYPNFSGAPDSFNSLHPGADSRPEWAIQPPVHLLHTSDPHGTSCAGTSDVSISCIQFSAWAAGQVPGSKRLPSSAALGPTPASLSPADDAGRRGCWPASGGCHALFFLHPLQPSAVPRPASHDAAHGPLPLTAGVCPHASEQPTHADVGQPSPGHRVILYPSVPFCRAAYPPSPLCHCSPVLPTPCHTAPCPPAAAGYHAYWKPAAVPACGPQSCPASGGAGPTLGQWTATAESVPPRGPDRHAALSATGTFCPVPSEQLPPASRCVCHPPPAAAPRLHQHGPCYPGPCPNWNHSSPAPSPWGSPPAPGDAAAPTPESWGAPPRRGAPEWGACTLSFHTLTLPLHRTPPSSPSTPRGTEDCPGRDLRPP

SEQ ID NO: 1677 - protein, 85 aa, Homo sapiens
CCCTHPRVMGGPPKARCPRVGCLHSQLPHPHPTPTSDTPKVSSLARRLDFQEEPMTGFFNLIPPSSSPSTPRGTEDCPGRDLRPP

SEQ ID NO: 1678 - protein, 352 aa, Homo sapiens
IHQYPNFSGAPDSFNSLHPGADSRPEWAIQPPVHLLHTSDPHGTSCAGTSDVSISCIQFSAWAAGQVPGSKRLPSSAALGPTPASLSPADDAGRRGCWPASGGCHALFFLHPLQPSAVPRPASHDAAHGPLPLTAGVCPHASEQPTHADVGQPSPGHRVILYPSVPFCRAAYPPSPLCHCSPVLPTPCHTAPCPPAAAGYHAYWKPAAVPACGPQSCPASGGAGPTLGQWTATAESVPPRGPDRHAALSATGTFCPVPSEQLPPASRCVCHPPPAAAPRLHQHGPCYPGPCPNWNHSSPAPSPWGSPPAPGDAAAPTPESWGAPPRRGAPEWGACTLSFHTLTLPLHRTPPR

SEQ ID NO: 1679 - protein, 67 aa, Homo sapiens
CCCTHPRVMGGPPKARCPRVGCLHSQLPHPHPTPTSDTPKFNLIPPSSSPSTPRGTEDCPGRDLRPP

SEQ ID NO: 1680 - protein, 66 aa, Homo sapiens
CCCTHPRVMGGPPKARCPRVGCLHSQLPHPHPTPTSDTPKVSSLARRLDFQEEPMTGFLPFHPPGN

SEQ ID NO: 1681 - protein, 66 aa, Homo sapiens
LQSPWGLPSPPRQSPYRIRRTNHPWHHQEALRGQSSPHHLVQAKLAAPRWASSREKTKMRALLLNK

SEQ ID NO: 1682 - protein, 62 aa, Homo sapiens
CCCTHPRVMGGPPKARCPRVGCLHSQLPHPHPTPTSDTPKVSSLARRLDFQEEPMTGFVSSH

SEQ ID NO: 1683 - protein, 47 aa, Homo sapiens
EKGFFISASISTRRRKRRNVFSASPAQHGLAFLSGPETRHQRLPKWR

SEQ ID NO: 1684 - protein, 40 aa, Homo sapiens
FSPSPTMRTRSSARRAVRKRIFYQRLNLYSKKKEKKRFLR

SEQ ID NO: 1685 - protein, 241 aa, Homo sapiens
QCIIKPVRAGPERQRARDPVPCLPHRRFHWRGAGAPLRRARLPGDQGGGGGQRLGPERLAVLPPAQGQRAGTLLGGSAHGRGAHGASPAGQRRAQAEPRGGHPGPRPAPSLRHCHAHRGRGRQDPRHPGRPGQPRALRHTQRFGPHSVPGGGGGRGLLRLPGLRHRVAGAQAAALAQVTPAAGFRRQLDRHAELALCGRGRGSGFPADLFPRGLPHCGLAEEPPDFPPAQLCGHAHQPGEL

SEQ ID NO: 1686 - protein, 82 aa, Homo sapiens
FSPSPTMRTRSSARRAVRKRIFYQRLNLYSKKKEKKRFLSKPRPTRTGVSLRPRDPAPAAPKMAMTPAPGPTTSLTQRCCKP

SEQ ID NO: 1687 - protein, 30 aa, Homo sapiens
SSKKKQNTRSTNLEKNPSLKKQSQRRGKLS

SEQ ID NO: 1688 - protein, 21 aa, Homo sapiens
VIDHQKKSKTQEAQIWKKIRL

SEQ ID NO: 1689 - protein, 87 aa, Homo sapiens
PTSYSRATASWASSCRRSTGASPPPFCSPWGALPPRRRRWRKGRAAGAGAVAPSRSSPDRACVCCRWKRSSPAASTGASPSSWRTSG

SEQ ID NO: 1690 - protein, 60 aa, Homo sapiens
DTRWEHWSCKSTDQPRSKFTQYCIFKFSFHFCSSAAGISGAKINNFFLCFFTCSWNNYYI

SEQ ID NO: 1691 - protein, 34 aa, Homo sapiens
LGNDQNVPGQWCTNRPSGEGKVHSHSFCCHPGSH

SEQ ID NO: 1692 - protein, 27 aa, Homo sapiens
NSPKKHLHRMLYMNRLQPSTQWYKITA

SEQ ID NO: 1693 - protein, 70 aa, Homo sapiens
GPETCIIEEDSYAGGTSYQLREEAATLVSTQSGSEIHHRVSQQTQIWWDVIPYILFFILHWGNKTRNTKC

SEQ ID NO: 1694 - protein, 75 aa, Homo sapiens
KPISLPKGRQKRSSRIPMHPRGLLRPSSSSALSIAQKSKENILACPLVMLRRNWERCGITLLQMTSSLMKRRLRS

SEQ ID NO: 1695 - protein, 74 aa, Homo sapiens
WAKEILRSREAKCHHMHFLCKLVGRSIRRSTQMLQSTSQSFLRSAQRGGRPCLLKRKENLKIWQKRTRPVMKEK

SEQ ID NO: 1696 - protein, 145 aa, Homo sapiens
PPATRARPHPPSVKPTRMPTRCPPTTSPLSKAAAPRRSTLRPRRPSMSRTSSKPTGAPTGRPPCRAVRCTWAGAATRIRCRPLPAPPSMASTTFPITLPGTWTTTGRPLWRPASTTDPANPTPPTQTSPLTTRLLLRVESKKRPN

SEQ ID NO: 1697 - protein, 34 aa, Homo sapiens
STRRTRRPRDWPRRRGAHLQPAAPRSPCSPRPAS

SEQ ID NO: 1698 - protein, 76 aa, Homo sapiens
KTTPPAQQRAVVAAAVAAAAEAVVAAGAVAAAAGEGTRAPRGRRRPSGRGRRTRARSWWSWRRSSILTATCAGLAV

SEQ ID NO: 1699 - protein, 54 aa, Homo sapiens
GVLVGAALPPSHPPCWGHSRPCLTGPALWSCISHWTNCSSGMRSCPWTTGHPSC

SEQ ID NO: 1700 - protein, 33 aa, Homo sapiens
PLWMKEGPPCHWRCGPPPLRGPQTHCERRNLSN

SEQ ID NO: 1701 - protein, 88 aa, Homo sapiens
GELGRSAGRSTSDCFFKTFMTATCVTLFWWPRVKKICGAVRLPSTPVSGHHCPVMIMLLMRAVRPVGTWQPQCSLSLAISPVTLCGEL

SEQ ID NO: 1702 - protein, 18 aa, Homo sapiens
FGRMGGRALSVATCSSSW

SEQ ID NO: 1703 - protein, 12 aa, Homo sapiens
GGAWPWQSWRNS

SEQ ID NO: 1704 - protein, 48 aa, Homo sapiens
TWPPAHTDQPWRVQTQLHLRLQEGGVQKSVPTLLPPAPFAHPSEDPVL

SEQ ID NO: 1705 - protein, 41 aa, Homo sapiens
AWAVSLAASAPRAWSGMRTDVWPWKGVPASIRARSMPLEKQ

SEQ ID NO: 1706 - protein, 31 aa, Homo sapiens
GGDWLTAGGLPVFLEECRLPVGLPGEPLPHQ

SEQ ID NO: 1707 - protein, 227 aa, Homo sapiens
RAPRCLPAATLWWTPSLLWPCVRRLCVSVLGGWSAPALPSWSTPGPVPRREWCCTAGPTTARAAQCALLVWSIGSVCPLAPGPARACTSMKCVRSDAWMAAAALRDSSWMKASAWRAPSVPACIPESATLPAPPSLETATPAFAETASGSAAMKNVQGSALSQVNHTSRALTTDTSPSVGSASTCWPGIARTTPSPLSLRLSSVLMTATLCAPAPSPSGCLACTTAL

SEQ ID NO: 1708 - protein, 83 aa, Homo sapiens
AVWMSWSSKGTRSLATSVTLPLKPLLLLCPPTWHKSLWARGSWGFRPWGPRGTPWFWMWRSSWKDRTKLVKPTSTGARSSWRR

SEQ ID NO: 1709 - protein, 72 aa, Homo sapiens
PAALSLTRMRNAMRPAWRAASAPQGSTWMRGGTACPRPSAPVTMTVRSSSQKTSSQTITPCATVRMASCTVP

SEQ ID NO: 1710 - protein, 121 aa, Homo sapiens
RPCPRRAGWPCPSWSGTANHVTRSKPRTWQPPPSRRAFPFLPTARSRCSTCSTTPSTARPAPPSTRQHTPWSRPSSGLGERRPNETRGPRPRPHPGGGGGEEASVLMVVIIIIIIIIMESS

SEQ ID NO: 1711 - protein, 121 aa, Homo sapiens
RTPSTTAATTRTRAGWPAPRAFSTPCTVWLPGRPLRTQAPSPRSPRPTSHRTMTRRPRAAGGTPARSESGECFSPRRRPTSWSGAFGSSGTCRRPSANTWPASSASRPRRSRSGSRTTATR

SEQ ID NO: 1712 - protein, 193 aa, Homo sapiens
QGDPGRRGGRRQEAKAASAFLQGADLRAGAALSAAAVPVGARARTPGQPHPPHAHAGQDLVPEPPLQDEARPGRERYGGDAPALAAPGGRARLGQGRQTMSRAQSPGPGSRHLPGGHSLFCLQRAVAAAHAVQRPVQLGQHPPVPDSTPPGPGPAVDLVSAAPTRLAAPGPGPTPAAVAARRPRSLWWLLLLL

SEQ ID NO: 1713 - protein, 49 aa, Homo sapiens
PRSSAACWRKREERRSRPCRCLSKVEAFPPVFLLDLQKSRTTYVWSKVT

SEQ ID NO: 1714 - protein, 255 aa, Homo sapiens
AIAGMDGEPSSPKSHPTGRAKVQAALGRNMALPTHADPGDLQTETMSQIPTDTLTHLVAGALRTAARRTRDPSSKMNTWQILKMQRTGPSGEGAPHAKISPLDSGASGKSGSPWACGDPRRSPTCWQVSGQAGPNCVLGTRVALWAAGPLSSPTRTPPITPMRSGRRPPKAATSASGGSGGKALGPSPTPRWMVACRGLVWVRRRSWPRGASPVRDPWLTDRAESWSREGLGRSPLGQVVVTPPLAMRANRMGRL

SEQ ID NO: 1715 - protein, 124 aa, Homo sapiens
REITGSLLMRSKPLGSEDRPGAGAVVSESSLFVVGLLAEMGAASVVGGSWGPAASTAAVSAAAVAGACESLRGQRTAPEPSPDGELPVRPIARAQSMKNFPSAAGRGAPRTGMKARSWRGRRAP

SEQ ID NO: 1716 - protein, 31 aa, Homo sapiens
SCPSLFSCHLGRASPLGPPEGFLRPGPSRQS

SEQ ID NO: 1717 - protein, 62 aa, Homo sapiens
HLLLLCQAATSRPCTWMAMCLQVSPGWFLKRYLSSRVTNRPPLPSRSRSPFTHLCRHKLSLD

SEQ ID NO: 1718 - protein, 58 aa, Homo sapiens
RCWTLRARRAVVCCFFVWGQRLRARKGNVSCLPSTWGTPAPNASPLLFISSVPSSLST

SEQ ID NO: 1719 - protein, 57 aa, Homo sapiens
CWTLRARRAVVCCFFVWGQRLRARKGNVSCLPSTWGTPAPNASPLLFISSVPSSLST

SEQ ID NO: 1720 - protein, 147 aa, Homo sapiens
PHRSEDAGHSGPAGLWSVAFSFGGRGFVPERGTCPAYPVPGALQPQMPPPYSSSRLYPVLSLPSGRAPSPGADAEVEPWPPLPAPAGPTAASAPAQLRAAPAPRRPGWAAAAAAPGRRRGVGAPPGRPPPVSSFQDRLPPCISSAGA

SEQ ID NO: 1721 - protein, 146 aa, Homo sapiens
PHRSEDAGHSGPAGLWSVAFSFGGRGFVPERGTCPAYPVPGALQPQMPPPYSSSRLYPVLSLPSGRAPSPGADAEVEPWPPLPAPAGPTAASAPAQLRAAPAPRRPGWAAAAAAPGRRGVGAPPGRPPPVSSFQDRLPPCISSAGA

SEQ ID NO: 1722 - protein, 97 aa, Homo sapiens
LRMHAPRASHQSSGRCSVTTWPSYHPRGTPQAVPPHLPTPRPPASGPLAPSSTHPSSLALSPSGRSLEWASEDTRWAALKPQRAPHPSSGTRCAFHS

SEQ ID NO: 1723 - protein, 82 aa, Homo sapiens
SGTMASPPRSCWPDCCLRPGPAACSPCSSEARVGSCSCCTWQEKGRRCPAWQAPPSLFLPGSTPSLHFLCWSLRSSGGCRSA

SEQ ID NO: 1724 - protein, 81 aa, Homo sapiens
SGTMASPPRSCWPDCCLRPGPAACSPCSSEARVGSCSCCTWQKGRRCPAWQAPPSLFLPGSTPSLHFLCWSLRSSGGCRSA

SEQ ID NO: 1725 - protein, 54 aa, Homo sapiens
RTFHLTCHQMINPSAVSCPECQTPPDEQMWVLVLCVVVTLQKFLSRLLLALLMA

SEQ ID NO: 1726 - protein, 46 aa, Homo sapiens
NWLVLRLRRVKSLCSSTWKSLQLVKEKMDLLLLLSLLPVPRRPCLC

SEQ ID NO: 1727 - protein, 28 aa, Homo sapiens
LKLSPKGCVFKRKCQKKNAQKLWKLKPV

SEQ ID NO: 1728 - protein, 167 aa, Homo sapiens
KSKIHHLQGQRTCLLAPKHLLLLWKQKNSCLHKNLWKVDCRFRSHQSLRFCQLRKTCLTRAIKQYLLMVALLLQGRKVGVLWLPLLPPLCISCSSLVRGPLFRTVFPRILQILLLLLLMLSDLLLLSFLAVPQSKKGDKISQWTRQCYLKKEESLFRRNFKVVNQWS

SEQ ID NO: 1729 - protein, 33 aa, Homo sapiens
NIRSVNPVVLKHILIVMSHLGQLQMNPRGLLKR

SEQ ID NO: 1730 - protein, 14 aa, Homo sapiens
KNRPMEGRGYWPEK

SEQ ID NO: 1731 - protein, 65 aa, Homo sapiens
RSLGKVVSTVTLMMTVRPKKFLRRGKKRLPGLTCKVRRTLHQLKLCQRVMILSVVFQILMTCQWP

SEQ ID NO: 1732 - protein, 64 aa, Homo sapiens
GKIEVGFVFRLVEDSVLQLKYIWYFVHTAFPALVRKLILNYFAINIIFQNFYIHLKLVFRVLSF

SEQ ID NO: 1733 - protein, 59 aa, Homo sapiens
DLVCGGPRQSLASWPQCPVPGGPWVLLCGCVMRPRVGWSPTSSTVPPLPFESSVCCWMA

SEQ ID NO: 1734 - protein, 56 aa, Homo sapiens
PWTLCHRQPHWRDPGGGTSGLRGRERVCLAHQGAGCWPATAVQQHGPGQHPGGGHQ

SEQ ID NO: 1735 - protein, 130 aa, Homo sapiens
FGTTVPSRCPPSGTLGQAPAKEWAPRAAVGNYGQQGARVRAREPRHPEQKGQPPGGTVFQGPRDLAPSWIQHHARRGQLLHQVQHPASLGQLPSRRPSACAPGVSSAAASSRSAPGRVPRDSRPVLKPGK

SEQ ID NO: 1736 - protein, 160 aa, Homo sapiens
AVPAPAGPRTRTASGAAATSGTMSWFDMAQPLTTLTTASRLMLAPLTWTWPCSIEMLAQTPTLTVTCPWRRRGVSPFHLQKARTMAGRGGASNGHSAEQPRVRGSSPTPKMWMAMTSCPTGQPWGSARQPPVLCRLGALKGAWGWTPARMQLTTTSQTRP

SEQ ID NO: 1737 - protein, 63 aa, Homo sapiens
RLISCSALTAWSTPVLPGGPVATLATIATSFEARMPGILTPMCCCLPSPHGHPHLKFCPQAAA

SEQ ID NO: 1738 - protein, 53 aa, Homo sapiens
VKGSKTCVECVVYLLQTPLAFSVLAWWQWSRKALLLLCQILCQLVLYLEEARL

SEQ ID NO: 1739 - protein, 32 aa, Homo sapiens
KLVSLTSMFQIGLVGKKVLLENLVYRNFGSGA

SEQ ID NO: 1740 - protein, 22 aa, Homo sapiens
TLVLLLHLFLAWRQQCLYQCGN

SEQ ID NO: 1741 - protein, 18 aa, Homo sapiens
MEQKAFLEILLQYMSPVD

SEQ ID NO: 1742 - protein, 70 aa, Homo sapiens
HSQCLLGGNGAARLFCYYARFCVNWFCIWKKHDSKYADISAKYPTGYIMYSYTCVSYFCFCASSFSYLYH

SEQ ID NO: 1743 - protein, 41 aa, Homo sapiens
CQQLSQCPMRVARLWFLRDSQLLSLMPGLSSLHLSLSIHPQ

SEQ ID NO: 1744 - protein, 102 aa, Homo sapiens
TPQILAQLVWKRLISHRCLENKELTWITQALNCQNFQTGHQVILLNQLNRGHFSRCLLNSCSMWHPHHSHHSSSHSHNCLSSSSHHLPVSHSLSSSSSSSNK

SEQ ID NO: 1745 - protein, 27 aa, Homo sapiens
TISKIIPTQINRRRRNPLGRRKIVSKI

SEQ ID NO: 1746 - protein, 85 aa, Homo sapiens
TQLIFPSCSSSSNNNNSSSSSSSSNNSNSSNNSCRQDPHSNISSNSHREFDPSLLPQLRCLFLQAGTSCLLEPFNLLQPRVLWAQ

SEQ ID NO: 1747 - protein, 13 aa, Homo sapiens
TPRAKILGPRPKG

SEQ ID NO: 1748 - protein, 65 aa, Homo sapiens
CPASVHYTCLYQFILNNSGYERITAKHNSCSPTDNQLWPDASLCCSCWPFTHTSEHKIFFCSCTA

SEQ ID NO: 1749 - protein, 118 aa, Homo sapiens
RTFQRWSFHSQRAHYQTRGKIIKATRFRQRELDLTRLLVCWHPKLLGLMVLKKRKTTMKQLQCWSRRFHLNLKVRKKMKLTLAVLPTLRNLHCYPQLCLQGRLAARNANMNLEILLGV

SEQ ID NO: 1750 - protein, 28 aa, Homo sapiens
WKRSSSSSRNIENRKKSEIGRQKLNSIW

SEQ ID NO: 1751 - protein, 89 aa, Homo sapiens
RTFQRWSFHSQRAHYQTRGKIIKATRFRQRELDLTRLLVCWHPKLLGLMVLKKRKTTMKQLQCWSRYEMVAFDFFQGSHWNDHGALVST

SEQ ID NO: 1752 - protein, 65 aa, Homo sapiens
NWKTKAQQHLVREKKKIRKEERRETKITTDQNRRRRKKRKRNLSNMTIQTMKTVPSNFWKGALLH

SEQ ID NO: 1753 - protein, 264 aa, Homo sapiens
NRPRSRRQGPRQSTRRTRSKPPPPSTAATTAAGASGWSASCGPTSGSTPGSGPSPAPSAGRTSARRRTWWRTRACTPASGPSPARSAAAASPRAAIWRRIGATTPPIGPSCVPTAARPSATNPTWRRTGASTPARSPTSAPTAAKPSARSPTWCRTGASTRASGPTPVPTATAASARSPTSSPTARATSGTAPSAVPSVARPSTTRRDSWPTRRSTMSETVGGAVLAERGLGSFVVGVAVGWGCLPSAGVGDNGNPRGDGRRGE

SEQ ID NO: 1754 - protein, 112 aa, Homo sapiens
VWPSLSPCPLLSTAPPGPCCCHPRPGLCLPPLWAELPRLGGPGSASAGPFSCKAAHRLSQMRETLLATKAASSSSAAVPPSRPGGPALHMRQLWPELCPVGPASCPQAGARS

SEQ ID NO: 1755 - protein, 69 aa, Homo sapiens
LRTGASTPARSPTRAKSAAAASGTNPTCCLTARFTSDPRGRPRPPPARGAPSCQPAPRSPRPSPPRRYL

SEQ ID NO: 1756 - protein, 323 aa, Homo sapiens
ALSDFAPAHPHRREALPVQRVRPPLPAQTQPAVSQQDSQAIRGVGPGRPRPGEPPAASRPPGVRGRAHPGGTSETGPGAAARGPARAPAGPDRSPPLPLQLRRLRQELPAGALPAGPPAAAHRGAALHLRRVREELRQEDAPGGALARALRRAALRLRGVRPPLLPGQPSGGASARPRPRSALRVSRLRQGLPPQTLPGGAPAHPHRREALRLPRLRQSLQPEVQPGVAPAHPHGRAALRLSRLRPQLQPEVQPHHPPQEPHPGRRLLLCHLWPDLRRRGETPGPPEEARCLRRWAGPCWLREGWGPSWWESQWAGGACLVLE

SEQ ID NO: 1757 - protein, 122 aa, Homo sapiens
RPRGTAPRRAQRAASATRASSSAPASASLCTSAAATSTATTTPWGSSSGPRPTALCNACARRAGTSTASTRPAAAGRCAPWRTATRAASPSGRPCACSARTRCCTPLTAPPTPSPPSSPTPS

SEQ ID NO: 1758 - protein, 32 aa, Homo sapiens
MVRKWNCLFSILRGSWKFIETKTVRQWSPRAW

SEQ ID NO: 1759 - protein, 106 aa, Homo sapiens
RASSSPAMGFSIPSHSTSPATWTAATATRSSSCAAPWPPTGRPAAPSGSLAPSGLRRRIAQEWLKIPVWGRTVPTELASWAMAGSCVAASSHPPMEITHMTLSMQR

SEQ ID NO: 1760 - protein, 102 aa, Homo sapiens
TPPVDSVETIIKTHWMTSSARMAGRPCLSWIWERAGVCTTQTGSATPAASTTAPSATLPLKPSTLALTTAASSTRQTALCGSVALSWTPLLLCTAACMTCAV

SEQ ID NO: 1761 - protein, 81 aa, Homo sapiens
GSMTDSAPASRGKILSPFRSTTPKGIVETLCSPMARISCIKTHSGSKAPTTLATSSPGTARSMWNFHVLMSWISRSPWILL

SEQ ID NO: 1762 - protein, 58 aa, Homo sapiens
KNGQGSTGKVPLPCLTRLPTGYLTPTCPQGRSPSALVEFSLLEHPPCSDQSIPRSHIW

SEQ ID NO: 1763 - protein, 54 aa, Homo sapiens
GTPQGSLNWWNLLEMEHTGKFIRVVMSKRASLQPSRLWMSQGMKRKKSNKKLTC

SEQ ID NO: 1764 - protein, 47 aa, Homo sapiens
LMLIQETLMISTYHLIFRAISLLMLLSSCLKQMEWKCLFAMRMRGCM

SEQ ID NO: 1765 - protein, 25 aa, Homo sapiens
SFYVKEMIRYFLHPCDLEEVAKCFS

SEQ ID NO: 1766 - protein, 17 aa, Homo sapiens
SLRSGQKNSSHLLRAAW

SEQ ID NO: 1767 - protein, 44 aa, Homo sapiens
VPVLSSALCPKKDHAGTSQEHPSVWALGGDCWERGRGCPADPQD

SEQ ID NO: 1768 - protein, 121 aa, Homo sapiens
VWGQLPASQFSDPSPGGLSARLSPCRIQVPQLFSGVWGCELHQVPHPDVALRGFPQVPHLPHGLQVWAKCPCPPLLPASQLPNSAGQADLQVRHVRHSLHSQTPPLLTLRPALAAPACQCL

SEQ ID NO: 1769 - protein, 37 aa, Homo sapiens
APPSSQTASAGTREQRPQGWGWGAWRLDLWPVSLLVP

SEQ ID NO: 1770 - protein, 33 aa, Homo sapiens
GAKASRVGVGGLEAGPVACVTPGSLSVMNTWPT

SEQ ID NO: 1771 - protein, 73 aa, Homo sapiens
STSAPCATQSSLTNPSSPHTSTSTCCPSVSVSLSARLVLCSLPKKGPCWNISRTPISLGAWRRLLGKGPGVPC

SEQ ID NO: 1772 - protein, 59 aa, Homo sapiens
DVSLQRQDAPGSCLRSLHLRVWLRVTPLCPAHSGPNHRFTRDYWQGSVWGSMAGPLEGW

SEQ ID NO: 1773 - protein, 40 aa, Homo sapiens
QTWAWLSVMMQSLTPLTLPRIRGWGPNDTWPLKYLMKPLI

SEQ ID NO: 1774 - protein, 32 aa, Homo sapiens
WFPFSIWMGWSTMCAPASPKWSWSLPGSPSTA

SEQ ID NO: 1775 - protein, 31 aa, Homo sapiens
LSWPCLLLVGWHTCTWRSWAPKGSLELLIET

SEQ ID NO: 1776 - protein, 104 aa, Homo sapiens
ASSPARCSSCSSSSSLFSLSLTIISVSITTARDWTWKIPHVRCVSPKTRRSRILSTISPPQGLAQGYPSLSSAQWPEPSFYKRLLARVGLGKYGGAAGGVVMWL

SEQ ID NO: 1777 - protein, 84 aa, Homo sapiens
WRSRPEPPPSSPLLSSCSPAAAGPGPGGSRLCCVRAPAASRPTTRVRQMGPAWFPFSIWMGWSTMCAPASPKWSWSLPGSPSTA

SEQ ID NO: 1778 - protein, 31 aa, Homo sapiens
RPYGRPLWTRLRPSLAGEKSPWSTHSSGDMV

SEQ ID NO: 1779 - protein, 204 aa, Homo sapiens
RHRPCGIVPLLHHHPPELLHGQPRGPRRHRSDTPGVWCGQNTPNIPDPLPAPLKGLREGGQRIPGSFSVPASVDNGSDSPQLPASERPATSQLPSPPWHQLSEVTLQVSAGVRLSKIIIYKIIYIYMFLFFETESHTVAQAGVQWRDLGSLQPPPPGIKQLSCLSLPSSWDYRHALPRLANFCIFSRDGVSLCRPGWSRTPELK

SEQ ID NO: 1780 - protein, 92 aa, Homo sapiens
ERPPPGLGGPVATLASAASSLGRFCLGQGCQYAPQQLHAWLFSLVLLSTPGHDAETTDDVSCPREHPRETSEQGKEDPGPACICEKEPKEQA

SEQ ID NO: 1781 - protein, 65 aa, Homo sapiens
SRAVILMRATPSRARRPCRHARQRCLQSGTFLPRPRVSVCPPTATCLAILTGTPLHTRTRCRDHR

SEQ ID NO: 1782 - protein, 58 aa, Homo sapiens
LPSPKAPLSSQPPACTRWDPSAGGTQTNTTCPFRQQILRRTKNFIRTQKLDHHLHMHL

SEQ ID NO: 1783 - protein, 57 aa, Homo sapiens
LPSPKAPLSSQPPACTRWDPSAGGTQTNTTCPFRQILRRTKNFIRTQKLDHHLHMHL

SEQ ID NO: 1784 - protein, 52 aa, Homo sapiens
THMPLPMDSSQSTLPKGKVCPMRSTPIAILSMDMVYASGQAVKQCAKISNHF

SEQ ID NO: 1785 - protein, 117 aa, Homo sapiens
STNAGCTAVRATACKRQRTPASHDDPPACEVYRTQSRPSALESGIKCHSLQVRIGGFSTELTSYSNDPNRPPDSRHPRPLCHHNHQHAHGGTHPQAVLRQIQRAHFVSRYCAEPRIL

SEQ ID NO: 1786 - protein, 116 aa, Homo sapiens
STNAGCTAVRATACKRQRTPASHDDPPACEVYRTQSRPSALESGIKCHSLQVRIGGFSTELTSYSNDPNRPPDSRHPRPLCHHNHQHAHGGTHPQAVLRQIQRAHFVRYCAEPRIL

SEQ ID NO: 1787 - protein, 20 aa, Homo sapiens
KTTGTVAASTFTTTTCWKTA

SEQ ID NO: 1788 - protein, 122 aa, Homo sapiens
NQQPTNTKSFFSGPTRRHSWAPKTSSLTRNPRRSLASPTRGKGSARGCGRSRTTLLSRLPAISLCCLCCSPPRKRAVWKSLNQSPKLQRVTVIRRGMQRAAATRKGSWSLMSQPRRRTRKER

SEQ ID NO: 1789 - protein, 115 aa, Homo sapiens
NQQPTNTKSFFSGPTRRHSWAPKTSSLTRNPRRSLASPTRGKGSARGCGRSRTTLLSRLPAISPPRKRAVWKSLNQSPKLQRVTVIRRGMQRAAATRKGSWSLMSQPRRRTRKER

SEQ ID NO: 1790 - protein, 84 aa, Homo sapiens
GCREINSQQIPSLFFRDPRDGIPGPQRPLPLRGIQGEVWQAQQEERVQRGAVGDREQPYCQGFRLSACAVSAAVLPEKELCGRA

SEQ ID NO: 1791 - protein, 77 aa, Homo sapiens
GCREINSQQIPSLFFRDPRDGIPGPQRPLPLRGIQGEVWQAQQEERVQRGAVGDREQPYCQGFRLSVLPEKELCGRA

SEQ ID NO: 1792 - protein, 169 aa, Homo sapiens
RGEQGTCWRTLLNVPRRQKTLKERRRRQPPWRLRGPFLWRWKRIAPPLSPALAGGLPKRKKKRRMKRKRLPRKMLRPQASEIMRACSHQCFKRSPHPVPAAVWVLLGKLAMACKLGTPFPPQPALLFYSLFPLQAQPMEIDLDGAGHLALTSRSPYSYDLSQSHVFSLE

SEQ ID NO: 1793 - protein, 64 aa, Homo sapiens
ASPTAVLFTHWRNSTLAWLLTWTKLKRRGRGKKEGEEDQRRKEEGEEKKGKKIKTHHAPGSTAC

SEQ ID NO: 1794 - protein, 112 aa, Homo sapiens
TITCACPSYSCSCTYNSATSTGPTTSTGSTCSWCSPAACFHASSGNTASRLWSWCSSSPSSSTIFAPRIQPNAFTTRFSASWTPTSYNSTSIHSSSSHSTNKHPKLYYRWYK

SEQ ID NO: 1795 - protein, 110 aa, Homo sapiens
TITCACPSYSCSCTYNSATSTGPTTSTGSTCSWCSPAACFHASSGNTASRLWSWCSSSPSSSTIFAPRIQPNAFTTRFSASWTPTSYNSTSIHSSSSHSTNKHPKLGVWG

SEQ ID NO: 1796 - protein, 79 aa, Homo sapiens
NLVLLIFHGTKSSLRNWRVFVKEECWTVTHLTQIGKEFLRSLKMKLLKMEVLKPHTQNQYHPYLNHYLCLSLLFLFLHL

SEQ ID NO: 1797 - protein, 177 aa, Homo sapiens
KVPSHRMAPLLGLVECQGSGAQGQAQGVLKTETEGNSRRSSHSSSHSRRRPSNHSSSSSSSHHHHNSLHQHSSSHSSLEMITGSSSIQVETKKGLEEDLLEIGWKMTGNGMGTVMMIEIIVTVTGESGEGGALTGTGTETWKREIDALVGIETEREILEIESLVERRKKPEERKSLR

SEQ ID NO: 1798 - protein, 57 aa, Homo sapiens
LLQIKKRKKKRKRKREKRSQKSRQNHLQLKSCRRKISNWSLKKVPALKKLRSPLWIF

SEQ ID NO: 1799 - protein, 120 aa, Homo sapiens
ANYKIRRSGKETTFQRLHLISVWHRNHSTAKYSWCIYGTHKYTIYLTSTSCISGLSIDGRACACSSWPYRKCDGTESKHDGGHAHAQWVYGKCTNWCDATSSERCWPPRRNGGTNGCTPE

SEQ ID NO: 1800 - protein, 84 aa, Homo sapiens
LLQIFPPLMLLFSLWYPLLLCKLLLTKINWRKKRKKKRKRKREKRSQKSRQNHLQLKSCRRKISNWSLKKVPALKKLRSPLWIF

SEQ ID NO: 1801 - protein, 54 aa, Homo sapiens
SGRRPQRERWLLSGVPATPQDSSCDGVSWTRKASPTGSPPPTSAVFPLTTETSR

SEQ ID NO: 1802 - protein, 337 aa, Homo sapiens
PRTGAGTAPQAAGSCGPCGANARGTAGEASRRGRAPACPRRAWRAAAARGCWRRVASATARPAAPLGAPAPGASPCGPQMPGGARSWGTSCSSLGSQPPRPVTQQPRSGPRGACAPAPAARAGRPARASACPPPTARSAADPCASSGCATTLPCAQCMVPGMSGRPGASAPAPVAVAFGIARAPAGPPSLGATPVRALRSKPSSATLPCALAGQWMETGMSGRAGAPAPPAAPRADSSARVNATGLPTGVRSARATGWRPETASCSSAQWMASGRPGRHGAVAASRVGLAASDGSVSALGPSSGEQPARAPRMSTGSAAPSGVPSPMRSVMRTTLVL

SEQ ID NO: 1803 - protein, 233 aa, Homo sapiens
AALNCTGCGTCVPGARRLGAPSSGGRCGCWPSVHPSACCCPGPRTACSTGSASRHTRGCTASGAASYPSPPSLCATTTRCASRASPRGTSTMPATGSGCCCPTAPRARLSASCCGATSRAASGSASWRTSASSCLRATSRESAPPSWTAWATSWRTCCSPASTAASSAGRTTSPPCLQNMGSVTCLTQARMANLCSPRSRGGQATGWRSCWTFSRMSTCPSGERQRKRHLKQE

SEQ ID NO: 1804 - protein, 29 aa, Homo sapiens
LRRGWQTSAHHGQGGDRQRAGDHAGHSAG

SEQ ID NO: 1805 - protein, 102 aa, Homo sapiens
KFRSTVSLSHLSSKSWALGWLQGSRPLWPHRSRGSHTCPHRGVSADPQRWASTFFLFTASPPVGLTVRPATLWKTATAAWFTCQGMPLFVPLSSTRSVQSLP

SEQ ID NO: 1806 - protein, 76 aa, Homo sapiens
CSTASSKGRSAATKTSPQCLQNMGSVTCLTQARMANLCSPRSRGGQATGWRSCWTFSRMSTCPSGERQRKRHLKQE

SEQ ID NO: 1807 - protein, 41 aa, Homo sapiens
ERGRAWLCVPVPASQSRPHPQEEEATPPGSWRAGQRAVSAQ

SEQ ID NO: 1808 - protein, 97 aa, Homo sapiens
TGEAQEGPVEAVPGAAEAADAPGGRLCPVHHAEPAAPCQDAHPEAGGSGAAGPTAQGEAAQQAAEPAAAAGAAPGAGRGGRAGAAAGGQSGLLRPLL

SEQ ID NO: 1809 - protein, 72 aa, Homo sapiens
WNPWPATSRSCCRRPSSWSAVRERPSMVMRPCARIAVQAPSTGGRSDPPRLLARRTAGGQCTMNWRSAGGPS

SEQ ID NO: 1810 - protein, 118 aa, Homo sapiens
MSISRPSSLRMSRTSPRGRTSKNSWLRGVDWHSTLSKSSAQKMTKMRMKMFKLRRMRKYWNHLPPGRCRRLKRAKSLRTHWRNVPSLVQIATALVTPTSLTRTSKSHLRKTKSTQLWL

SEQ ID NO: 1811 - protein, 26 aa, Homo sapiens
VFYFDGDKSPPGVPDGSHIPTISSPY

SEQ ID NO: 1812 - protein, 193 aa, Homo sapiens
MSISRPSSLRMSRTSPRGRTSKNSWLRGVDWHSTLSKSSAQKMTTMTMKMFKLRWLRKCRNRLPPGRCRRLKKRKSLRTHWRNVPSLIQIAMALMTPTSHIGKPKSHLRKTKSTQLSLAHPLMLNGKMLYTLFQKMKVMMRKRKKKGQCLPGICRSLKRRKSPRSPGMKVIRLPQFLLKCWPRTSLTAAHFTH

SEQ ID NO: 1813 - protein, 38 aa, Homo sapiens
TTGCSVPGSNIQAQEEKREKREKEETEGREASRPSWGR

SEQ ID NO: 1814 - protein, 37 aa, Homo sapiens
WLRCLLCNLPLPTHHPRRCPIPKSQDELPTSCNTYTR

SEQ ID NO: 1815 - protein, 82 aa, Homo sapiens
EPHNGFGACFATYPCQPTTPGGVQSQKARTSYQPAAIPTQGSDEGSVETSVRMAIPAACGCCQTGSTGLSQNYKTAYGHGYY

SEQ ID NO: 1816 - protein, 79 aa, Homo sapiens
LPTISSLGKGMQGCWGWAQKQQHQGRGFENPLSCMRALRAPQWLRCLLCNLPLPTHHPRRCPIPKSQDELPTSCNTYTR

SEQ ID NO: 1817 - protein, 70 aa, Homo sapiens
SGKQILPPLHLQPSWLLVLQLALLGVLSLRQHGFPLCVERVVAPSSPHAKTCLTLSNNTRALRKESFQNS

SEQ ID NO: 1818 - protein, 54 aa, Homo sapiens
GRPGPGVLPPRRGQPGRCLPGRPPSSSASSASAATSPLRRDCLSRGAREVLRIR

SEQ ID NO: 1819 - protein, 120 aa, Homo sapiens
PLSDQEKKNRGFPRPSPHRETGKNLVPEQENEMEKGKQQGQISRFPAGGEGRGNEKGSPRAGGRQSRRPDKLTSTFKIYHRLLKLIITICCGHHLFSLLERTLPVFQATFMSLLLRFSVL

SEQ ID NO: 1820 - protein, 169 aa, Homo sapiens
TRCTPSTRRRLRRRRRRARPSIPLTTTVTSRPRSAAVTPPPQQPCSSMATAPPASRTRPRRRTRTRTRPRRPPGLGAAVGKAGARSTSTPAGAARPLPTRPPPLLLRILRLRRHLPPAAGLPVTGSPRSFTDTITYRDSRFLRPSKRPSWYNILTVNRPVVILARTQTT

SEQ ID NO: 1821 - protein, 46 aa, Homo sapiens
GSWGCSSSSSSSGSSSSPVPSTSQRLTMTIRFFPASRMPSGGQWLQ

SEQ ID NO: 1822 - protein, 107 aa, Homo sapiens
GTSTSSTATGPASTPSSTTTSLGAACGGRSTCPWTFSWRRSASTSWGTRPWRPSGRTRAACPKVARTRSRCPPSPSSARCGCSLSTQRALGRPGASPSSPCWSFSSP

SEQ ID NO: 1823 - protein, 84 aa, Homo sapiens
VESPQFPGGVRRKRRMKTIPTHFIMASPLGKWGPGAPPHSVLLGAPSLQTPSFWWRRCALSGSLLSSWCASPPALASRPSSGTS

SEQ ID NO: 1824 - protein, 44 aa, Homo sapiens
STRWAPLRRSKPARASTRPSSDCGASAPRSCRRPFWSRRWWSCP

SEQ ID NO: 1825 - protein, 125 aa, Homo sapiens
AAVPLPAQAAWCQGYLGCRTWSPACPTTFTIHPPAPRCPPPWLQSQAQATQAGPEGAAETDEGERAAGEAPSPKSSHGGGRCRRCMSPTACAPEGLSPQGLSPSGFGSPGLSPPPLPGELDVPRE

SEQ ID NO: 1826 - protein, 29 aa, Homo sapiens
LSVTCTGSSHSMRCLCPGGATASRTYSVC

SEQ ID NO: 1827 - protein, 125 aa, Homo sapiens
TPLDWSGWPKRRPSTGHGRLSQFRSRDCGLMSMRLGSCSAKECPQLTTAPSTTTPCDPAEVMSSAPVRPRCCNCIQRTGQQWPPWGKASAVASSWTGPTSTQNRGARLQTVATWCGQGKRTCCSQ

SEQ ID NO: 1828 - protein, 87 aa, Homo sapiens
PQSSSGQWRTLCRRPWGRMRLCTWRRCPWRSLPRSLACALWMRFTQTLCGWYQWGCPWPMHWTQPPKPHCRPLWSYAVGRTCYVLGL

SEQ ID NO: 1829 - protein, 70 aa, Homo sapiens
SFGTWSSCNTTERQMEACSPCPSGMWTQEWAWKGWWLCCKANTPPMTLTSFPRCSTPYSRAAGHPLTWAE

SEQ ID NO: 1830 - protein, 135 aa, Homo sapiens
RRRWQWMTTSCPWMSWAANTKWTCPRASPTSGLRTFWLEMGPTPSHHLPQPLSGSSSAVSFSGGSPSCCGLGLSSASWPTASRLPWRMNHPTTIYIWVWCWQLWSLSLAASPTTRRPRAPRSWIPSRTWYLSKPL

SEQ ID NO: 1831 - protein, 34 aa, Homo sapiens
ETETPRWQRFLSTLPTSTSCLSTSEKTAPRATCW

SEQ ID NO: 1832 - protein, 112 aa, Homo sapiens
ALLWLSEENERQKPQGGRDSFQLYQQVPAVYPRARRQPPEPRAGDEGGPRAHSGPVLHHPGAGQGDPARQGDARCLSKCLHGAGGTWGACAGILSTESAIWKVSSGLQIRHG

SEQ ID NO: 1833 - protein, 122 aa, Homo sapiens
GGRPPGLLPPPSQTPPLTGAPTPPPRAAAASAPMVFSPHHHPPHPPSLPPGTPLDSPWLLPISSFLPHLHPPSCPLLGSSEALAGRCPPPQLQEAAEGDGGADLGLMRRGPPALWGQPFWKL

SEQ ID NO: 1834 - protein, 89 aa, Homo sapiens
PERQHLPREQQPPQLQWSSLRITILLTLPVSPQGPPWIPHGSSQFLPSFPISTRLPALCWGPPRPWPAGAPLPSSRRQLRGMGGQILDS

SEQ ID NO: 1835 - protein, 130 aa, Homo sapiens
DMDRVTTVIPRYLGATPCSQSLHLHPTLLPAIPLHSRLVMIRAVTLSRTPMGNRAAMDSRVAMVNKAAMGSSLPLVTHPKLDPTAKLQVNIANRAAATGSRVHSDRTTPVAWVFMGRSLEDFPDQERTGA

SEQ ID NO: 1836 - protein, 237 aa, Homo sapiens
WRPRITVPIAKLQRSRATVLTPPSPLKDMHRPPRHMGNKAMEPMDSPLMSAIPRLRPLQPMGRPPMQLLMDSLPLVILLQLPPRHTASLSRGMALVLMIPPLLQSPPPRPPMQLSLHMALSLLIQPMGSSQQPLHLQAIPLHSRLVMIRAVTLSRTPMGNRAAMDSRVAMVNKAAMGSSLPLVTHPKLDPTAKLQVNIANRAAATGSRVHSDRTTPVAWVFMGRSLEDFPDQERTGA

SEQ ID NO: 1837 - protein, 92 aa, Homo sapiens
KGPVQVILLQLPPRHTASLSRGMALVLMIPPLLQSPPPRPPMQLSLHMALSLLIQPMGSSQQPLHLQDRRMETSPLRLVNLNLAQGVTTSPA

SEQ ID NO: 1838 - protein, 81 aa, Homo sapiens
SWQRWPWWHAGRKRWPHGSWWSRWNVQRWPWWRQRWLPWWPGHGPRWLWWRKTRWPWGAPWTFDGTDGRKKRRTWRTWKNG

SEQ ID NO: 1839 - protein, 173 aa, Homo sapiens
TVCGVVCHPVRAEACHHHSVEVQEAQEVLGDPWVAWEAVEEIEEASLQEDPGVPEGTPLEEETSSTELETGSVPIRVVETRTSPGEQSATSVRPQSLKASSRHPFRPRVVIVAEVALVACGEEEVASWIVVVPVECSEVAVVETEVASVVAGAWTEVALVEEDEVALGGPLDL

SEQ ID NO: 1840 - protein, 162 aa, Homo sapiens
WRPRITVPIAKLQRSRATVLTPPSPLKDMHRPPRHMGNKAMEPMDSPLMSAIPRLRPLQPMGRPPMQLLMDSLPLVILLQLPPRHTASLSRGMALVLMIPPLLQSPPPRPPMQLSLHMALSLLIQPMGSSQQPLHLQDRRMETSPLRLVNLNLAQGVTTSPA

SEQ ID NO: 1841 - protein, 109 aa, Homo sapiens
EPSRSSRLRTPHAAWHSHPLTCSLRLTITRSRQPASGPHLPATCSLASTCWWLGCQACSLPAWQLSLHTWPSGPTPRSQSMGHWWWRMWWHPASRPWLTTTWLSWPSGP

SEQ ID NO: 1842 - protein, 31 aa, Homo sapiens
DSFTAWHGAAGPRGRVCIGTPSCSTAWGVSC

SEQ ID NO: 1843 - protein, 54 aa, Homo sapiens
WGPQTGASTQPGSSTTSSRASGVVPQVLQGVQACPRGAEAEEEAKAIGVPLAGR

SEQ ID NO: 1844 - protein, 46 aa, Homo sapiens
HCVSGSWGPPRTVPRQRQRGPERHRAGDHDPRGQGRPGHWQGRGDH

SEQ ID NO: 1845 - protein, 263 aa, Homo sapiens
RSPGSCHPTGTPTSSCSSSGVHPSRLTTPSSLSRKRSRVLSAQLDQAQVAQALLAQWGPSILGPSTRGHPGLPHMPGGPLLTSTHPRAGAIPTPSGSRLLLMTQAKQLQRPRTPTPRGPPTTHTTTSSPRAPSPAPHRPLRPHRLRVSPLSPHPPASRTTLRPGKSITKRSASSPSSPEHPHSRTTRRLGRSTTRSKRKWPPEGVQELPQAPSQTTVPPGRNITDSRPLTTDRPQVLAAPSRRPRSRDSSRLNESNECELLHL

SEQ ID NO: 1846 - protein, 122 aa, Homo sapiens
RDRAREDCSYNGAPRQVRARSPDHQRPPPEPQEWSPRSSRGSRHAPGGPRPRKRPRQLGSPWRGDDLLHPHSQVWAGHRPRWRECESHKPADGSLRRDLPAAATQRGPQLQVVHHPGFTPAD

SEQ ID NO: 1847 - protein, 49 aa, Homo sapiens
AGPACQAWEEMGKKMKVMKTGWTMQSGALGPRGQLGRCRKLSLLGGSPK

SEQ ID NO: 1848 - protein, 46 aa, Homo sapiens
LRQMQVTRSSLMKSIRTRAATPGATGSRPRTPTRMRTAIKQHHPAS

SEQ ID NO: 1849 - protein, 34 aa, Homo sapiens
GLWSKFTSVARHTEQESREETTLFLMSCFSTMST

SEQ ID NO: 1850 - protein, 17 aa, Homo sapiens
SIHRRKTTGQRCLWSCE

SEQ ID NO: 1851 - protein, 60 aa, Homo sapiens
GSPMPHPPLERGGFSPQNPRPPGLASEILLSLLLCAPSTWMRDPYCMTCCPSGLPPIWIL

SEQ ID NO: 1852 - protein, 150 aa, Homo sapiens
GECGSLWRGPQESDHLWLGGWGLLCQPVDPVPLLRRSLPEGHHSERHRPVQLGSELPAGQVHSDIGRQGRLQHAGHHGHGRMPAEQELQGAHPADHHPGHLPHSLRAGDRRRRHPRRPPDPDGARRVPQLRHHAGRQPRGRPEVRGRHRG

SEQ ID NO: 1853 - protein, 49 aa, Homo sapiens
PTGRTSPKLVIQINQFLRIPSSFTQNPTALKKWPGPSIIPKTSSICILA

SEQ ID NO: 1854 - protein, 59 aa, Homo sapiens
WWRAPDWIRRQALPRQSSDHTLREFLLNSLLSLWSQVPGCEEWNSFSARFTTRSNCHLS

SEQ ID NO: 1855 - protein, 72 aa, Homo sapiens
SVLNRIFSYTRHTQKYYLCFQKLGALGEEQTSQLQETFLTILPRLPLQAFHVILDTCLPGRLSAPLGLQEKM

SEQ ID NO: 1856 - protein, 62 aa, Homo sapiens
LFLMQATLCARQETWPQDPTTCQFFIQEMGMLVLVMFPDTSTLCPKCFIIFLRISAYMVEAS

SEQ ID NO: 1857 - protein, 142 aa, Homo sapiens
RAPGAPGWHRVAALRVAAAPAVPARQPHSAHLPWLPRVHRPGPEQEHARGAPLHLCASISLGHPSPRTPKGLPTPAATHTSRASHSEATGPEEECGHLAGGFSKEGTGPRCQELISCGPTLHALHGLHDPHRQRSQFTWKIG

SEQ ID NO: 1858 - protein, 31 aa, Homo sapiens
CGTAEADPAGATQKSLFFPGEIADTERSMEN

SEQ ID NO: 1859 - protein, 68 aa, Homo sapiens
DLWALRAGTRRCQAEGSQGPRQGSSSRPPLLPTSHSGGVSMPKAARRPSLDLRVPWSACTQGITSEAR

SEQ ID NO: 1860 - protein, 61 aa, Homo sapiens
KIRREKRCLCFLTRLCLHSQLLRASRPHSPVLPPALCGPLWRFDSSPSCKPTCRTDLTHPS

SEQ ID NO: 1861 - protein, 118 aa, Homo sapiens
KAPRSPGARWCLRGSSGPLPPPSITTTASPSCSHSWTLEFPRLSRAPRSSAAAPLSPSCHRPAVGRGSRGCPRWTPPSLPEDHCRCPLSGNLQPAIWAPQTSRRRSLWMPSCPGTPAN

SEQ ID NO: 1862 - protein, 30 aa, Homo sapiens
RLQPLRAALTAGLWSFPGCRGPRGAQPQLL

SEQ ID NO: 1863 - protein, 27 aa, Homo sapiens
SGREKPPGAQERGGACEAQAGLCPHLR

SEQ ID NO: 1864 - protein, 96 aa, Homo sapiens
ATVGAPPRCTWPWRGGCGVSWSSCWRGRSVSTPRMRTSGQPSTLQPRTGTSLAHGCCWRRTPRSTRWTLRAGRPCTWPASTGRRISCASCCAEAWT

SEQ ID NO: 1865 - protein, 254 aa, Homo sapiens
SQKNLSSKYSLQKDHMFQGPGPVAGSCVSADVLPTAGGLCHLGGPEGAGQGLSADLVSALVGLQPEVSPAETAAGEGSATPPPAAAAGGAGPVEDAPSAVCQEEAPAQAEHPTAGTETQPDLLPPVETTAGSQEAGAAGDSAGPVVLGLLAAGKGVGHVAGLCTGKEEKEGAAAVGAPGLPGAAPPGGCHAAPALCSQHEGLPAAAAGPAAGPGGSQSPSCRPPLCHALETESAGPGREASAPGSHRTQQESDV

SEQ ID NO: 1866 - protein, 123 aa, Homo sapiens
AEKGKRAAPLTACCLGPLQNSTAVQMYRIVATVYSEEAVQAAATGQSGWSFPAESPACCLPHMEQTLAMAPPGKCPQCKSNTFPQGDIREASIFSLEAEDVSASRKPPGRENGHPSRRATASV

SEQ ID NO: 1867 - protein, 242 aa, Homo sapiens
SQKNLSSPGPVAGSCVSADVLPTAGGLCHLGGPEGAGQGLSADLVSALVGLQPEVSPAETAAGEGSATPPPAAAAGGAGPVEDAPSAVCQEEAPAQAEHPTAGTETQPDLLPPVETTAGSQEAGAAGDSAGPVVLGLLAAGKGVGHVAGLCTGKEEKEGAAAVGAPGLPGAAPPGGCHAAPALCSQHEGLPAAAAGPAAGPGGSQSPSCRPPLCHALETESAGPGREASAPGSHRTQQESDV

SEQ ID NO: 1868 - protein, 240 aa, Homo sapiens
LTRAGCEASSGRWQPGRASTTGSCCAGHYVAGKRTPWPEWMKPKKPFKQVLITEGPYVPRSWSSGGKLCQCRCITDSRRTVPSGRPRRCWTGAVCGPGFSAGGTAAGGQPSRDCSWRGQCNTTTGSCCWRGWPGGRRTICSVSGRGSCTGRAPNCWHRDSAGPASASGDNSWQPGGRSSGRQCGPCGSGPSRCRQRCGPRGWPLYWKGGERRRGCSGRSRPTRGSSSRRVPRGSCALQPA

SEQ ID NO: 1869 - protein, 228 aa, Homo sapiens
LTRAGCEASSGRWQPGRASTTGSCCAGHYVAGKRTPWPEWMKPKKPFKSWSSGGKLCQCRCITDSRRTVPSGRPRRCWTGAVCGPGFSAGGTAAGGQPSRDCSWRGQCNTTTGSCCWRGWPGGRRTICSVSGRGSCTGRAPNCWHRDSAGPASASGDNSWQPGGRSSGRQCGPCGSGPSRCRQRCGPRGWPLYWKGGERRRGCSGRSRPTRGSSSRRVPRGSCALQPA

SEQ ID NO: 1870 - protein, 47 aa, Homo sapiens
APRTPRGRLGLAGDAGGHVVQRVGVRHPERLRGALRVHAGNLRLQRR

SEQ ID NO: 1871 - protein, 37 aa, Homo sapiens
MKDFKMKKIKRLFSCALASLQELDDCSLAGLQIMCLV

SEQ ID NO: 1872 - protein, 112 aa, Homo sapiens
DSMGRFSLHGDDFLLLPNSQRLHRPIWLSENSCRGCCCWICWAHVQFFCKFHRASVPYLWNHICLRLLLCIPAFIGHFGTLFQEAPWTGEWHCHCWQQCLHNPAAFALKGSD

SEQ ID NO: 1873 - protein, 144 aa, Homo sapiens
LDGLLYWTSLGFVNRPQWTTSGVLMMMVILKVEIKLPFRETGMWEPPPPPRTTASPAATAACCPSARTCSRRTPRPPGPCREFILGTGIKNVTSCCRFCAGSELWARLCPGRRGRPFGWPWLLQGRQPLECSGGWGLDGTSLLL

SEQ ID NO: 1874 - protein, 42 aa, Homo sapiens
LDGLLYWTSLGFVNRPQWTTSGGRQPLECSGGWGLDGTSLLL

SEQ ID NO: 1875 - protein, 113 aa, Homo sapiens
GQESKMLLLAADSAQDRSCGPGCVQDGVVGPLAGRGCSREGSLWSVLVAGDWMVPVCYFDFLAECVSSYQVPSKHLQVFSLAHPTLPFTSRSLLTGPGQFLFVLARVELGKHA

SEQ ID NO: 1876 - protein, 111 aa, Homo sapiens
LDGLLYWTSLGFVNRPQWTTSGVLMMMVILKVEIKLPFRETGMWEPPPPPRTTASPAATAACCPSARTCSRRTPRPPGPCREFILGTGIKNGRQPLECSGGWGLDGTSLLL

SEQ ID NO: 1877 - protein, 28 aa, Homo sapiens
NRPSKKQSVRLVSSSCPQSSTSSWSWIS

SEQ ID NO: 1878 - protein, 82 aa, Homo sapiens
TDHSGPLLGEGSLWSVLVAGDWMVPVCYFDFLAECVSSYQVPSKHLQVFSLAHPTLPFTRSLLTGPGQFLFVLARVELGKHA

SEQ ID NO: 1879 - protein, 80 aa, Homo sapiens
GQESKMEGSLWSVLVAGDWMVPVCYFDFLAECVSSYQVPSKHLQVFSLAHPTLPFTSRSLLTGPGQFLFVLARVELGKHA

SEQ ID NO: 1880 - protein, 38 aa, Homo sapiens
PGSKQPCQICLENASVSGQTRSPHGPGRGSGEGLRPGA

SEQ ID NO: 1881 - protein, 107 aa, Homo sapiens
SVMTHRRHCGLARWILMKIFCWRVSTVTSTAGALTNPHSCYTSVLKVGATGVGQSLSVWTMPGLLLEQFSTGVELLLSSSRFSNSMEYKNRLSSVEDRSSVVTCLKA

SEQ ID NO: 1882 - protein, 70 aa, Homo sapiens
MESERDCQSNSTTDWWTTSQRHLVTWPPAVLPCKYHALWWLQNLPPPLLKHTITWLIHILLRSSLVNLPW

SEQ ID NO: 1883 - protein, 126 aa, Homo sapiens
SHCCADPGRRKKRGACTGMGPHGSCTSTPARASASRPCRRAPAAKPPRPHRRPTSMLRRTATRADAQHWPRSSWTSPLSRPLGAQDRRRGGGGGAAPSPGPARWSCFWWLTRPWRGCMAGACSITC

SEQ ID NO: 1884 - protein, 90 aa, Homo sapiens
VLRVSRHGCLCSPVVCCGTPGPDGLSDQEAACGGRDALWKGENLPAGQMCGQNQEKILFNVKPWQLGILGILGPVFSLMWRRSAVCLSSL

SEQ ID NO: 1885 - protein, 164 aa, Homo sapiens
CCSGGRPCCCARSACPWPRSAPPRHLPRIKPGSLRLLQQPPSPAGGRGRRCRSEPSLPATRTPWRSGAGARGWCRTSTNSTPAAARWATSSTRAAGGSSWTWSEMVRWALLASCPQEAGRVRPGATGATASIGAQWTVVPALWLSLTSVGVSTASSRSSTRATP

SEQ ID NO: 1886 - protein, 117 aa, Homo sapiens
LEYQESLTKKQSRPRGKRKMCQKSTRERLRNKPQKKFPTKARGSIRMKMITEPVRARNPKRRTRIQQAISHPATESHLSRVLQKKRICCLLPLGLFLQKIQKQSMALGRGLLVSLLP

SEQ ID NO: 1887 - protein, 83 aa, Homo sapiens
SQAVTATRRRVAAAKTVPPHQSRRRPKGRLPVAPRRLRKRLQVAPLTVLHLHQLLILLSLGEQSLSLMTEIIQQTIIYKKQKS

SEQ ID NO: 1888 - protein, 71 aa, Homo sapiens
KQIPHPQIQMKVRAFLLPHKLLSTPRAIGLLLNPPQWRKKIAFFGNECSLLWKRRNFFHPSVSLMTGTHLL

SEQ ID NO: 1889 - protein, 59 aa, Homo sapiens
PQDSLYQELLQTTRWFIQLFLHHQLRLPCEELLCRLLLFGRSIPKIVLQFECLKQPHML

SEQ ID NO: 1890 - protein, 119 aa, Homo sapiens
REWSFTRPQKTKSHSCINHEFFSACVTTIATHTTSTASSTIWGANKWTISDHHTLTTYSSNYRECNTSSSNSGDHKTPCTKSSCKPPGGLYNSSCTTSSGSLARNCYAGSCCSAGQSPK

SEQ ID NO: 1891 - protein, 97 aa, Homo sapiens
KIQTLWRQMKSFLFWKSLHLLRMNLLAFLKHLSFQSMRQIQIWKRKWKVLLVHHLNKKVVRVCQKKPFWSSLMKRIFRVKKMSLKLYRKMKRALQQK

SEQ ID NO: 1892 - protein, 96 aa, Homo sapiens
KIQTLWRQMKSFLFWKSLHLLRMNLLAFLKHLSFQSMRQIQIWKRKWKVLLVHHLNKKVVRVCQKKPFWSSLMKRIFRVKKMSLKLYRKMKRALQK

SEQ ID NO: 1893 - protein, 83 aa, Homo sapiens
VVLPKIQYPCHPCQIPLNQTTFLLCPVLVFKGTLLPVLHHWEQHLLCRLFQQHTLLYKPQGLLYPQWAHQDSIVHQLIEVLYR

SEQ ID NO: 1894 - protein, 80 aa, Homo sapiens
PQDSLYQELLQTTRWFIQLFLHHQLRLPCEELLCRLLLFGRSIPKIVRDFSCIWPQDTCSSLQHLVGMAYNNVKFCKNFL

SEQ ID NO: 1895 - protein, 138 aa, Homo sapiens
SMKMQVSFTREGSLLLRLITVLCCFKISPIMSALALEAASLLRSGLSHSTTHITLISSIITASISSKGGLLPVPIPHPSHIEMLLLTSCLIWRIILTNPPLRGAATRVRHQHPPLPGARAVVDMVAGEVPKAEITAEG

SEQ ID NO: 1896 - protein, 62 aa, Homo sapiens
INGWKLSHMSWMISCVMNVRGPVVGGNLLHFSVLMLPVCSITVNIAGLLSILVLAGNSTSPW

SEQ ID NO: 1897 - protein, 55 aa, Homo sapiens
KLRRARVKKRPGSERKKRVPGPRQEDIRGRHTKEKEAQRRWQQRSESSCSFLLGT

SEQ ID NO: 1898 - protein, 41 aa, Homo sapiens
KLRRARVKKRPGSERKKRVPGPRQEDIRGRHTKEKEAQRRV

SEQ ID NO: 1899 - protein, 37 aa, Homo sapiens
KKAGVRKKKEGPGAEAGGHQRKTHQRKRSTKEVATAF

SEQ ID NO: 1900 - protein, 73 aa, Homo sapiens
LAVTIQTVQLSGFTLPAWTLPRNPKENGSVHGVSRKRGRRSRRSCVPGSEEQVNLSLHSCRNISLPFKTTLFG

SEQ ID NO: 1901 - protein, 70 aa, Homo sapiens
KKAGVRKKKEGPGAEAGGHQRKTHQRKRSTKEGLSSLTPSCPCTPLMCWTCPWTQTNPRTACATRSPMGR

SEQ ID NO: 1902 - protein, 124 aa, Homo sapiens
SAVEQTRASTSALRRSLEMECSSHGHTTWCGRRPSMTWMWSPAGSTRLSAARTEIFGYLTSAVESRRSCLKGHRVRTAHSLRCRQTPQGSTLPPAVLTRISPFLTSPQASAWPPCLATQRLSLA

SEQ ID NO: 1903 - protein, 211 aa, Homo sapiens
CRDQPRCHRHLVSSREAMVPIPLEHPRRWNRPLATPAPSRQPLCCCHDAVSTLTAAGLPREWPQPAPFLDSRRPSLCTVWCHRKDMRPVCRPLHQAHCCLGRSKLRMVWAPCPQLMAVRLGLTPIRTPPPVPWPRYPAVSLLGRTWAWWLNLKLMPPSESHHSASWPCPAGLTWSWTSPNHCLTVLPWLHSLLSPKAGPLARQKSLASRWA

SEQ ID NO: 1904 - protein, 40 aa, Homo sapiens
TSSLKKSRKTRVQMSVGIFQSMFSTVTPLAKPKKRFSKHS

SEQ ID NO: 1905 - protein, 35 aa, Homo sapiens
NTFLTFWTPRLKTKKSQILTSYIFGKQTAFLFASG

SEQ ID NO: 1906 - protein, 34 aa, Homo sapiens
DARSPSSKNSSQTGCPSAFLDFSGRLSESPSICW

SEQ ID NO: 1907 - protein, 53 aa, Homo sapiens
GVRELSGHSEECASACLLYCEEFYSKKHKNKKGLPERKTQWTCGHTVSLHAVA

SEQ ID NO: 1908 - protein, 50 aa, Homo sapiens
GVGIREEGSYTPCDRVSPDFYLSSGSCGYSHLLEEMLPDCTLLLRGQYIP

SEQ ID NO: 1909 - protein, 86 aa, Homo sapiens
MIQTPTKTVLWIRIIQSHTHYLRILKKIIESQVYPQTVKLVWTEVLVNHHQQMGYPKSTMMEKRKMTFRLVVLCFLSALNLKHGQF

SEQ ID NO: 1910 - protein, 113 aa, Homo sapiens
ASSASWLLAWAPSPVLTCSTAPSCGAPGRPRDRWCARPATSPGPMAPAVARASSASKGPAWRDTTSTSTGWMVPGPNGIPMAPARAHVVGACSWPGGSAPTPPLPTGASTARE

SEQ ID NO: 1911 - protein, 71 aa, Homo sapiens
VTSTPSTGTLPSSSPGRTCVEPPPVTPWAWLMWVPCVTPREAALSLRTMGFHQPSPLPTSWATCSTCPMTM

SEQ ID NO: 1912 - protein, 163 aa, Homo sapiens
LPPGPTQQAHLPARGSAGRQLHPEPAVRAGFWRGLQALSLHAVLHQAVVHREGQGTDGVPDPPLPLGRWHQLWRGQALPQRGLRGETQPQQAQGGWFLGQMGSLWPLLAHMWWGRAAGQEAVHQPHPCQRGQVLRGSEGEIPILQSGALPQLSLRKELPGGAV

SEQ ID NO: 1913 - protein, 52 aa, Homo sapiens
KKMERNPGKGAIFFYGLLEFIMYPKERLRHLEIWRVLYSLKMSTFTMGLSIK

SEQ ID NO: 1914 - protein, 238 aa, Homo sapiens
PSMGRLSMITTSGLWQRLDLPLGGQTWGQSMQLHQLSHLQDLKQAPPSPMDRFPRLHILSVLFSKRPRDMLKHRRIRSQPSGTTTTRQCPGPRTPPSPACPRPLRCGGPPTPAAVPPRPSRPRAQAAGACPPHPTTSCRRRHRRRPSMTLSSRRRPRTSWSRPQTSCPRPRRRTQGSRAQSCPRRRRRRPRPRPPPSPTPPGRPPRWPRGLLCPPRGKRTQGTPAEQEAGSKISCQTS

SEQ ID NO: 1915 - protein, 72 aa, Homo sapiens
TGVFMKSTRNYKLRGFLKTMKMLLKSYQTGQETQKIKYYFWRKRRNMLYLKTPRISTWITEEKKKARKLMRK

SEQ ID NO: 1916 - protein, 43 aa, Homo sapiens
EASHKLFSQTRRSRTDTPSRSFESTDETIAEKRSKCFLFISCD

SEQ ID NO: 1917 - protein, 37 aa, Homo sapiens
QKEGIPGPYKRWRCHCLKMKAILGHLTQQKKWSRLQK

SEQ ID NO: 1918 - protein, 36 aa, Homo sapiens
QKEGIPGPYKRWRCHCLKMKAILGHLTQQKKWRLQK

SEQ ID NO: 1919 - protein, 22 aa, Homo sapiens
FTGCFNKRRAFQDPTRDGDVIA

SEQ ID NO: 1920 - protein, 44 aa, Homo sapiens
WQVQTGDMMTKMVLNNGASCIPLPMEITSPLLILKPVKPNMTPL

SEQ ID NO: 1921 - protein, 48 aa, Homo sapiens
YPPSPPCPDPAQVSSPPYPSLPHKPPVRSGRQQLYAVRQCQQRRVLLE

SEQ ID NO: 1922 - protein, 263 aa, Homo sapiens
VRVTLGTPRRPHLALTPWTPCQVRPGMLTKILSHPTSLSTTASLSLPSWTPSRPSHAEATQPQGASSLRTPWTRLRCRPSPTTPACRPWSTMRGCCCVKRLRGLEACTARLHCLLGALRRSRPAWPGSTAEGSSEGQRGGWDAALSKQLANHSRSEKQVPQPHPREPERLALRREPPPSLRSTAVNSCVAMYRGHSSMKGCGFPFYFFTFPFLWVFLSFLYAVDAFFLLQFWTMWSYMEKLHRQNHFATLQGPGVGAQALPPG

SEQ ID NO: 1923 - protein, 116 aa, Homo sapiens
CCCCPHTGTAQAVPCIQQPSWRTDSRRISSEPCSSKWSEPANPAVIPICLWLKKVITPYTLTPSTTLWVIPPQPSLPGPCASLLSTLSQPPPQAPSQVWTAATLRCPAVPAAACPP

SEQ ID NO: 1924 - protein, 58 aa, Homo sapiens
QLRAAPGPVPCPPHPPELPGPTPGDPAAHSWGQHHQPQQPPHPDLRPPGCCPRPRHCL

SEQ ID NO: 1925 - protein, 160 aa, Homo sapiens
RWPWCLAAQGRPRPSSVPASPPRASWTYPWRSSRSQLGSTPPTPAASSPRSAASWVLPTSTALSLRTTWTPRRWPRSLTSSPPRPMCPSSASAEALLWSSPPRSRAPPSCSWACPWSSSCRCCSRCWKSTTGAPSPSSPACTRATRSSWRACAPSPTPAT

SEQ ID NO: 1926 - protein, 121 aa, Homo sapiens
HSPALPSSRTRSSCATRRNCCGTWPLGCTWSFGGHSCGPGAWASARCTGRWADPQAPPAPPPQPACCLGTVTPPSSTSESSSKSWWNSGHGSAVAPHAIPSTWASGRTCQLGGPRRRAWSW

SEQ ID NO: 1927 - protein, 222 aa, Homo sapiens
QGGPPAPGSATELPGRPSADSVMGGRSSPNQGSWRGTRRASPDWGLCWRPRAPCWGAVRVGSRDDPQPRAPARGTNDRRGRGPRVPAPGRAVPVTLPKRLHRGARAQPRGAGRDHHVQGPHGAAEGGGTPELHVPIRPPRPSCPGHRPPAGSIPQPCRAPGPEAAALHGGTAAARGPWVAPGASGATAVGPAHGQVQGVLGGGRTPRLRQPLHPSLPAASEL

SEQ ID NO: 1928 - protein, 193 aa, Homo sapiens
QGGPPAPGSATELPGRPSADSVMGGRSSPNQGSWRGTRRASPDWGLCWRRGRGPRVPAPGRAVPVTLPKRLHRGARAQPRGAGRDHHVQGPHGAAEGGGTPELHVPIRPPRPSCPGHRPPAGSIPQPCRAPGPEAAALHGGTAAARGPWVAPGASGATAVGPAHGQVQGVLGGGRTPRLRQPLHPSLPAASEL

SEQ ID NO: 1929 - protein, 137 aa, Homo sapiens
QQKRQGYTPVWPRTWWGLTLRRLVWLWAVLSSSQAGTKDRGWSSGCRRPTPITSCYLGSPHPTQCPPTSPGPVPPPSGARGPQLWPACLGEPTATTLPASFRPRSTGPACKWPLLMPTPSWLVYGPGPKRPLLATEP

SEQ ID NO: 1930 - protein, 47 aa, Homo sapiens
PGWRTTALQGWPAYRNSISTTTSSTASPPGPFLASATCCGCTSTPTS

SEQ ID NO: 1931 - protein, 104 aa, Homo sapiens
RPTLAQANPGRVWVGGGLSLQPGLSGAGVPLLSGLCLLPSSCPGIQGGSCPDPQKGRHCCHHCLKILEAQPVLSSREITRTTFYQKRSSLGQMPCQERDMDPRA

SEQ ID NO: 1932 - protein, 40 aa, Homo sapiens
PPGLRNRFSEPLSPSHGGWGWVLRTQTVFLQGECATKPSG

SEQ ID NO: 1933 - protein, 35 aa, Homo sapiens
MRPAGRWCSAAAWRSPLSAATLRSTSSSGRMCYET

SEQ ID NO: 1934 - protein, 113 aa, Homo sapiens
EQCLPHLSFSPRQGAAPDTEPSAWGPAPTGATGPGLPLRHVRLFSAGAPRGAATPCPPALLHGPAWPPARPMFRGHPPVRPLGPWGKVAAGPRALCLAGVPAVQGECATKPSG

SEQ ID NO: 1935 - protein, 91 aa, Homo sapiens
ALCLGPSPNRSHWPWSSASACPALFSWCPARSCHAMPTCAFTRPRLAPGSPYVSWTSAGSAAGTLGESGSRAAGPVSCRSTSSSGRMCYET

SEQ ID NO: 1936 - protein, 15 aa, Homo sapiens
GVPAVQGECATKPSG

SEQ ID NO: 1937 - protein, 57 aa, Homo sapiens
LSVTPAYQIRVKMMAHVIVIQLTFTDAPVHMVSRGRTVMSQFMPASVTHVNMEELAT

SEQ ID NO: 1938 - protein, 54 aa, Homo sapiens
RIISIPTRLRPVVPVAPAPAAWQTKELDRSKARNSVVQLKNSISFQVQKIIDQN

SEQ ID NO: 1939 - protein, 88 aa, Homo sapiens
KICNWITTRSAVLKMGHSGLSGTWKCSLSTITTLLDFLWQVSTICLNLGLFDCIQTTCIVTATWPGSPTGFAKGLGLVCTLSVWAPPT

SEQ ID NO: 1940 - protein, 139 aa, Homo sapiens
WGSVRRAPRTPPFSARNSSCRIMRTSSPAWGCSSCWGLCSREQQKHPSCFSLFSTVLLSLQQRNKPRAQSPSIIMVSKIWPRFSSTCWWQSLFMPQFRNMCWIKLTRECSSPKRNKTSLTSLVSLVCSTFFLVFGAHSF

SEQ ID NO: 1941 - protein, 13 aa, Homo sapiens
KKNRKRSGSGNFK

SEQ ID NO: 1942 - protein, 35 aa, Homo sapiens
WGAGSTRPSPDSWCFLSDWLVAGREAGRGRRQEGE

SEQ ID NO: 1943 - protein, 76 aa, Homo sapiens
CWASWSCCCWGLRGWRARPAGRMRRSPSCWRASAWWCATPTPRPTPRALPWASLCALAAPRWLSLPSGAPTTSRPR

SEQ ID NO: 1944 - protein, 34 aa, Homo sapiens
TAPCTQSVAPQHTWLQKSLQRLDTASRWTSGQQV

SEQ ID NO: 1945 - protein, 26 aa, Homo sapiens
RGETFLMPLLPLTNTPRETPVGCCTT

SEQ ID NO: 1946 - protein, 43 aa, Homo sapiens
MQLRNLMIIIQIKLTGHLFLRKSIFLIFLPETYIGIMLIVCDG

SEQ ID NO: 1947 - protein, 32 aa, Homo sapiens
YTYKHAKCTWKEKLGKGKMEVKEMQIFFQMCK

SEQ ID NO: 1948 - protein, 112 aa, Homo sapiens
CMGSSSGHHDTRPCPGTASAAREGQSCKARAREKRGRNEGKTGRGRAKEAGRTPKTTGGNSSATAGRRKEKARGRRTCPKETGRGSASPAGARNCIKATARRGRKTAARRSS

SEQ ID NO: 1949 - protein, 76 aa, Homo sapiens
KLFSSSSNSNSRNSQVGGMSANLQVPRNLFWRSSRKRPGKCKSSSSSSSNTSNQTELVTIRIPTCTPALGILFGAL

SEQ ID NO: 1950 - protein, 266 aa, Homo sapiens
PAAYSPATAPVQAPPPLRDRMSLWPRPRNQLQVQLPPGDRMSPRSQSPGQPWAPPPRQPTMSPQPRTTSQPRAPPPPQPTVSPRPRTPGRPRAPPPPQPMVSPRPRTTGPPWAPPPLQSTMSPRPQALHQAQLLLWCTTAPLPGLPQPQPARALHSQFPATTLILLPPLPAIAPRLMPVALTIARYLLSPPPITALLPSCLLGSLSFSCLFTFQTSSLIPLWKIPAPTTTKSCRETFLKCFCRFINKGVFWASPILSSGQDLWWYN

SEQ ID NO: 1951 - protein, 30 aa, Homo sapiens
PSIHFLRGQSHYSSWPSRCCSLSSGTSRTR

SEQ ID NO: 1952 - protein, 29 aa, Homo sapiens
SKVKQMRTPKKSSLYACESLKNFQTDLKW

SEQ ID NO: 1953 - protein, 42 aa, Homo sapiens
FREQRGEYHLTKGENGITDIRTSLTGSSSNLSQESQIPSCRL

SEQ ID NO: 1954 - protein, 91 aa, Homo sapiens
NFCQKKRRRKRRKKKMMKRKRMKMHQGAIKIRKKEDGTKGLSRCFMVFSVLLLKLELNLSVCLSYVEIRTENKLPQSSTASWFLKSSKLLS

SEQ ID NO: 1955 - protein, 28 aa, Homo sapiens
ESRSEVSIASFRDSKPKKRNTNTPGSAS

SEQ ID NO: 1956 - protein, 22 aa, Homo sapiens
PQWRPYYSKPKKRNTNTPGSAS

SEQ ID NO: 1957 - protein, 22 aa, Homo sapiens
QKRWPFSSQGDCKTCRGVLPFY

SEQ ID NO: 1958 - protein, 42 aa, Homo sapiens
PMRMPSTVLSAVKHKPGQLLLFLRHFMIYSLLQILSMQLLVL

SEQ ID NO: 1959 - protein, 30 aa, Homo sapiens
ALYYRKSMESFGDCRKKIAWSPWHENFRSR

SEQ ID NO: 1960 - protein, 32 aa, Homo sapiens
PSCCAWTHDSGPRSRGCLAPPTLPSSLASASP

SEQ ID NO: 1961 - protein, 72 aa, Homo sapiens
PVGKPGGQRTTAPGLQRAVRPAGGAAGRLRGAGQELPQRGPAGTRPQPGAHLPADPRAAPGLTTLAQDPGAV

SEQ ID NO: 1962 - protein, 41 aa, Homo sapiens
RRRCPRCSGRTTRRRSWSTTWPRSMAGSSGSTRSHLGTSPI

SEQ ID NO: 1963 - protein, 84 aa, Homo sapiens
TGSCVPSYLTLCWRASASSTHQGSSLGRSRGSAGGMTLQLSLSGLPSGLTASFCSSMPTNWTSLMSSQKSSKPSRTTRTRCEWC

SEQ ID NO: 1964 - protein, 329 aa, Homo sapiens
APHHLPVSLLPVRVAGLPGASGRGPCQRGLQPRAQPHPLRDHGPCTVHHRLPPGLLLRHGQLHLVGHPVAHLVPGRRHEVGQRGHRGLRAVLPPGCVAHPQRQVHHGTGAELRGRGPSGRHLLRGQPEPELAARLRAGPAGALPAGGHALPAGGLRVALPHPQRHQAGRHQDGQAGEAHDPHRHLHAALHGPRQHCGGLLPVRAALPRELGGGAHLRLPGPRHRPAARQARVLGAHAQVLHVPGGGHHVGRLDLVGQDGGVVAAFHQPLLLPPAARPQERGRHGRRGLPRGERRAHRQDRAAGPRRHLPQAGVPVARVGGCRRGTRPES

SEQ ID NO: 1965 - protein, 81 aa, Homo sapiens
YRGAHSAARPPGQLHDPDQCHDLPRAAAPRLAGAATAPTGTRRPPARAVRAAAATRAHPRGRGAPSRRRPLQAGQPGWRGG

SEQ ID NO: 1966 - protein, 161 aa, Homo sapiens
PTPGSRTPPCRRRHRPHRDPAAPSTRRSRRRRHSCPSPGARRPLPAAPPASWAARLERRLRCLEASRWYRLPMASLLSSFPTGPSRTAALSSPSTPATAAPPWAPTQCHLPAAPRLRRTPCGGRGGTEGAQATPPPKLPNPPLFPPDSKQELEYWERRGLF

SEQ ID NO: 1967 - protein, 41 aa, Homo sapiens
MGGSLKLSMWRQTEAIRAESCTPAPAMSSTFFGWDSQLYCT

SEQ ID NO: 1968 - protein, 16 aa, Homo sapiens
DKIWLYKLFRKLTTEV

SEQ ID NO: 1969 - protein, 76 aa, Homo sapiens
VKCQPKILDKSEIHPNLGRIIKPCRKFETLCFHLQMKQILLGVLQKLIHKCFKTCKLLDLMRIWLYKLFRKLTTEV

SEQ ID NO: 1970 - protein, 18 aa, Homo sapiens
KLKRKILFLEPQLSKGQS

SEQ ID NO: 1971 - protein, 81 aa, Homo sapiens
IQKLRKPPGQKRKTELFTRHTRDWGTDGQKSQSYCLDELIMLSRTTGILQCVGRSNRKVICRSLQKPASQQWPQASRRTVI

SEQ ID NO: 1972 - protein, 35 aa, Homo sapiens
KQLRSEKRNRKKEWKRKYRENEKWKRGSLMIKKHL

SEQ ID NO: 1973 - protein, 17 aa, Homo sapiens
IITGSKTQTHRGRAREG

SEQ ID NO: 1974 - protein, 513 aa, Homo sapiens
RPGRRRQPPAVPDAAAVPGAAAVAAAPGGGAGRRPGDPASVPLAHAHQQLRPGRRGGDRVPGGRQPPLSAVGRQPEPGGRGGRGPGARQPAVSRSAAAAGLVRAPAAPHGQLQQDPAAGPRPGPGSRVRVHLPGLLPAAAPGQHLGRGRALPARRAARRARHGVPQHAERGGQPPERVHRGASSASRRGRGGQPPARGRHVHRLRQLLLPAQPQPGGPPLREHARDRHPLPGHARRPGQALHLRPQPLRRQHPQDQAGRQGAAQAGLRERLPAPVRPAAGCTVLRVPGAQQRGARGRQGEPGAEPAGAHLPAPRRRRRRQEAHRVLHPVGLAVRGRRGPRRPLQPPGVGLPSPGAALCCLRAAPGVPRGPRCSGRTLRLPLRRRASRHPSCAHRLLRGTGARRGGGARQRGAGHGTGLRAQAQHPAPARAAGLWSCSPAAPAVHPAAPEGHARVPRPGPHLRGRGQRQQLHSGLPGHGQREASQDQPEREHAGGEQAGGDCGLWGARAPCHAV

SEQ ID NO: 1975 - protein, 71 aa, Homo sapiens
QNHPLLGQRVPGRGRGAAAHHNPGRELQPDHRHTAAGGQRDGHHRVHRHLQRPAAALRGGPVRLLYQEPTC

SEQ ID NO: 1976 - protein, 157 aa, Homo sapiens
EQTCVWRHRHPHLWSEHPCAWSGHIRQQPLLWGILSTRPRLCWCCTFRIGGPFIFHWCGIQDPRGSTATAGPKAAHPQKVAFVPCPCSPHPFPKSGPWHLLGRALDPSSCVKQTYPGSLASAARGQWQPWGPFPSGGSTSLREGEAGCGGPKPGTST

SEQ ID NO: 1977 - protein, 62 aa, Homo sapiens
RRCRLPRACHPAQNLLEQQPLRPSHLQRHPASYPRWVYHSQGRQGCSPAPPLTPNPRPLCWG

SEQ ID NO: 1978 - protein, 31 aa, Homo sapiens
GFYLKRATLEKGTCELNHNLLETFIQRPCGT

SEQ ID NO: 1979 - protein, 163 aa, Homo sapiens
RESGNSAPQFLTVGGSAGRAGAGWDRTLCTSRHPSPVTAASRGGPPQARLAPQEETAFAQAGELCQEAAEAQGHLRSHCPKGRVPASVPGPRSPLLLHGEAWPTGGPGPHRGLRGGIRSAPLAGPKGECGPYNTRTPANLPLHFAALCGPHTPPEARTRGAWA

SEQ ID NO: 1980 - protein, 139 aa, Homo sapiens
TKVTSAPSSRRLSGSVCSTRKTTRTTSTSPGGGRTGRPPRARRSAPVGRPSKVGPPPSRPTTRAPTWTTGTQERAPPCQMGTPSTPQARAMAHPPLQPPRRQSCSRARQTRSGTGAPWGRAGSLTSTSATWTLVRSATR

SEQ ID NO: 1981 - protein, 111 aa, Homo sapiens
GRRTWWPWRRVCWTQPCCQHSYRSSRISRRSWTRACTNSRSCSGRDRGCCRGATQPRRPSRSDWRSWEHSGVSCKTTPRRRWPSSRRPVRPCVCGGAWRNWRTGWSPSRLS

SEQ ID NO: 1982 - protein, 203 aa, Homo sapiens
DSGPAELPAREPATATVGRECPGSAAQQGGVSGCGLGSAAAEGAPRPAGGDPPVAGEAAAAGRSEPAHGSLGLPRLPRGAQHSEGPGAAGPGAEGFVGAEAAVAARGAGAAEVWPRSGWFHCHLCQPPGLAAPGQPWGGREGGPEPAAAAPGVWAAPEHPGASGRGSAGTRREAGSEPAPSCTHGQRAAAEYPGTVDQAPGEE

SEQ ID NO: 1983 - protein, 26 aa, Homo sapiens
DGTLPEKAVRRASKTSHPSRPETSSL

SEQ ID NO: 1984 - protein, 212 aa, Homo sapiens
GSIQEKSLSCARTVAGRFVSGATCVGICGSTPGSVLTAAHTVPMPSPSCLNCGAISSHTPGRPTCARCVARPSETHTRSELTSACTPERGPFPVPSVAVLTRWPPSCGATSNLTWRTSPTAAPPVAWATPSRRASGGISSVTGLRHPAAHPLCLLLLLSPLWCSCRLSHNCWTHTERRKSPPPGMLLRSPFQKARRSALWCQRSQMPPPAWC

SEQ ID NO: 1985 - protein, 148 aa, Homo sapiens
ICSPTILGLPKTTTPLRTVRTASRAQTPSSSPGTASRPCWMCNGFLPSRASKMTAASLSASISQPCLSRITSKRGVTQWSKANQLYLQLCWPASQEVDLFSCGSFSWSCYQTNPASHSSAGLETDGSLSSPTPMRWPAGGERGKISPR

SEQ ID NO: 1986 - protein, 56 aa, Homo sapiens
SPSPSSASARTRRSALTTAASPSTATRSWVGARARRRRSTKMISCWCRAKWRRGTP

SEQ ID NO: 1987 - protein, 59 aa, Homo sapiens
LMGQGASSLEHQTCSLPSMRLRSVKLLEFAKEFWNILQWQRWWRLWKIWSLTQRILGQE

SEQ ID NO: 1988 - protein, 73 aa, Homo sapiens
PRLLYGRHLRPVRNAPSCVLTQAAIRDILSCPTYRCTAGSTLVRNHTSVTSRTVNEGFLVQTSSKDTKGDIQV

SEQ ID NO: 1989 - protein, 97 aa, Homo sapiens
RSGPAAGPEGRLLFGVARLSVPRHSRLEHEASMFADFIVVTATVQRCPGSPPLSEILWKDEPFAISSHAGLPWLSSWPAPPWTWSWISRRREHGRGS

SEQ ID NO: 1990 - protein, 55 aa, Homo sapiens
FILERNPTNVKNVAKLSTGPQTLWNIREFILERNPTNVKNVAKALVHSQSLLNIR

SEQ ID NO: 1991 - protein, 55 aa, Homo sapiens
FILERNPTNVKNVAKPINGPQPLVIIRKFILERNPTNVKNVAKVLVCSPSLLNMR

SEQ ID NO: 1992 - protein, 55 aa, Homo sapiens
FILERNSTNVKNVAKPISGPQPLDITRKFILERNPTNVKNVAKPLVRSQSSLNIR

SEQ ID NO: 1993 - protein, 139 aa, Homo sapiens
FILERNPTNVKNVAKLSTGHQTLWNIRKFTLERHPTNVKNVTKPSAGPQALLNIRQLMLEKNPTNVKNVAKPSAGPQDLLNIRQLMLERNPTNVKNVAKLSTGPQTLWNIREFILERNPTNVKNVAKALVRSQSLLNIR

SEQ ID NO: 1994 - protein, 111 aa, Homo sapiens
FILERNPTNVKNAAKPISGPQPLVIIRKFILERNPTNVKNVAKVLVCSQSLLNMRSFILERNPTNVKNVAKLSTGPQTLWNIRKFTLERHPTNVKNVAKALVCSQSLLNIR

SEQ ID NO: 1995 - protein, 111 aa, Homo sapiens
FILERNPTNVKNVAKPSAGYQSSVNIRKFILERNSRNVKNVAKPISGPQPLVIIRKFILERNPTNVKNVVRLSTGPQTLWNIREFILERHPTNVKNVVKALVCSQSLLNIR

SEQ ID NO: 1996 - protein, 31 aa, Homo sapiens
FILERNPTNVKNVAKPISGPQPLVIIRKFIL

SEQ ID NO: 1997 - protein, 107 aa, Homo sapiens
RNPTNVKNVAKLLTNLQFLLNIREFILVRNPTNVKNVAKPLVRSQPLLHIRQFMLERSPTNVKNVAKPLLRSQPLLHIRQFMLERSPTNVKNVAKPLVSSQSLLNIR

SEQ ID NO: 1998 - protein, 27 aa, Homo sapiens
FILERNPTNVKNVARLLTNLQSLLNIR

SEQ ID NO: 1999 - protein, 23 aa, Homo sapiens
KLVIPMWMSVRCTKKVIINLTRV

SEQ ID NO: 2000 - protein, 23 aa, Homo sapiens
RNPTNVKNVAKALLCSQSLQNIR

SEQ ID NO: 2001 - protein, 83 aa, Homo sapiens
FILERNPTNVKNVAKPLVRSRLLLHIRQFMLERSPTNVKNVAKPSVRSQPLLHIRQFMLERSPTNVKNVAKPLVSSQSLLNIR

SEQ ID NO: 2002 - protein, 83 aa, Homo sapiens
FILERNPTNVKNVAKPSAGCQSLVNIRKLMLERNSTNVKHVAKPISHPQPLVIIRKFILKRNLTNMKNVAKALVHSQSLLNIR

SEQ ID NO: 2003 - protein, 83 aa, Homo sapiens
GILERNICNVKNTSDHFACFHTYLNIKEFILERIPTNVKKVAKLLTGPQPLLIIRVLILERNPTDVKNVAKPLVSSQSLLNIR

SEQ ID NO: 2004 - protein, 79 aa, Homo sapiens
RNPTNVKNVAKLLTDLQSLLNIREFILMRNPTNVKNVAKPLVRSQPLLHIRQFMLEKSPTNVKNVAKPLVSSQSLLNIR

SEQ ID NO: 2005 - protein, 71 aa, Homo sapiens
FIMERNPTNVKNVIRQLMLERNPTNVKNVAKLSTGPQTLWNIREFILERNPTNVKNVAKASVHSQSLLNIR

SEQ ID NO: 2006 - protein, 139 aa, Homo sapiens
FALERNSTNVKNVPKLLTNPQTLLNIRKFILERNLTNVKNVAKPLTGPQLLLNIREFILERNPTHVKNVAKPLTSSQTLLHIRESILQRNSINVQNVVKLLAGPQTLLNIRKFILKRNPTNVKNVAKLLSGPQSLLNIS

SEQ ID NO: 2007 - protein, 124 aa, Homo sapiens
FILERNPTNVKNVAKLLNCPQPFLHIRLFILERNPTNVKNVAKLLTDPQTLLNIRKFILESNPTNVKNVAKHLTIPHTLIHIREFILKSNPTNVKNVAKLSTNIQTLLHITKFILERNSTNLKM

SEQ ID NO: 2008 - protein, 37 aa, Homo sapiens
KKTIKVWMSVRCTEEVIMDLTNVCQLPRAKYFYLINV

SEQ ID NO: 2009 - protein, 111 aa, Homo sapiens
LILERNPTNVKNVAKLLTISQSLPNIRGFILERNPTSVKNVAKLLPNPQTLLHIRKFILERNSTNVKNVAKLLPNLQTLLHIKKFILEENPTNVKNVAKLLTSSQLLLNIR

SEQ ID NO: 2010 - protein, 111 aa, Homo sapiens
LILERNPTNVKNVAKPLTGPQPLLNITEFILERNPTNVKYVAKPLTSSQTLLHIREFILQKNRTNVKNVAKLLAGPQTLLNIRKFTLKRNPTNVKNVAKLLSGPQSLLNIR

SEQ ID NO: 2011 - protein, 27 aa, Homo sapiens
FTLRRNPTNVKNVAKPLSGPQPLLNIR

SEQ ID NO: 2012 - protein, 22 aa, Homo sapiens
AILKKNFSNAKNVANHFACFHI

SEQ ID NO: 2013 - protein, 22 aa, Homo sapiens
KKTFQMQRMWQIILHASTSSST

SEQ ID NO: 2014 - protein, 78 aa, Homo sapiens
ISANVKNVEKLLTALQSSLNIRELILERNPTHVKNVAKSLIGPHALLHIKKIILDTNSTNVKNVAKLLTSPQSLLPIR

SEQ ID NO: 2015 - protein, 153 aa, Homo sapiens
MSSCSKSLRISVEVLLTTRTQPWSPVRATPSLCFILTQIKRTSRCLLFCLPRTSLLSYTTPNSNSSNSSSSSSSSSSSSSNSSSSSNSNSNSNSRVQFQLNNSNSSRAQFQPNSSSSSNNSSSSSNNNSNNSSSSSSNNHLLSLPNLYQASLC

SEQ ID NO: 2016 - protein, 166 aa, Homo sapiens
LRSSEPADAFCFAFPEQAFSPTLHPTATAATAAAAAAAAAAAAATAAAAATATATATAEFNFSSTTATAAELNFSPTAAAAATTAAAAATTTATTAAAAAATTIFSACPISTKPAFAKVTFATSAKAPTSANAESAHCRNGIPSLPTTETGSTLCGRPEHRPQSKS

SEQ ID NO: 2017 - protein, 107 aa, Homo sapiens
PIQERENINVMYVARSLIRSNTLYIIIDVTLVRKLTSVMSVGRPSLRCHPLYAIVDFILERNLTSVMSVARPSVRSHPLDAIVDFILERNLTSVMSVARLLVEIQPL

SEQ ID NO: 2018 - protein, 335 aa, Homo sapiens
FIRQFILERNLTSVMSVARPSVRNHPFNAIIYFTLERNLTNVKNVTMFTFADHTLKDIGRFILERDHTNVRFVTRFSGVIHTLQNIREFILERNHTSVINVAGVSVGSHPFNTIIHFTLERNLTHVMNVARFLVEEKTLHVIIDFMLERNLTNVKNVTKFSVADHTLKDIGEFILGKNHTNVRFVTRLSGVIHALQTIREFILERNLTSVINVRRFLIKKESLHNIREFILERNLTSVMNVARFLIKKQALQNIREFILQRNLTSVMSVAKPLLDSQHLFTIKQSMGVGKLYKCNDCHKVFSNATTIANHYRIHIEERSTSVINVANFSDVIHNL

SEQ ID NO: 2019 - protein, 397 aa, Homo sapiens
HPISTTSALHRVLQLHAWPGHGASPTSPSPWHDSAYSAQYSHSPTSSSAGYRNAATPSPSSSRSGHTSSAASTRSRHTPSAPSTRSGNTSSAPSTRSGNTPSAPSSRGRHTPSSPSSRSRNTSSTPSTRSGHTPSSPTSRSGHTPSAPTSRSGHTPSSPSSRSGHTSSTPSTRSGHTPSAPTSRSGHTPSAPTSRSGHTPSSPSSRSGHTSSTPSTRSGHTPSAPTSRSGHTPTSPSTRSGHTPSAPSTRSGHTSSAPSTRSGHTPSSPSTRSGHTPSSPSSRSGHTSSTPSTQSGHTPSAPTSRSGHTPTSPSTRSGHTPSAPSTWSGNTSSAPSTWSGNTSSAPSTWCWDSPTSSLARYGDSTCSSSPTPSTWDRNPTAPSASCIRPSTPPTSWE

SEQ ID NO: 2020 - protein, 387 aa, Homo sapiens
QCLLCPVQPFPNLLLCRVQKCCHPLPLLFPERAYLLRRLYPEQAYSLCPLYPEREYLLRPLYPERQYPLRPLFPGQAYPFLPLFPEQEYLLHPLYPERAYPLLPHFPERAYPLRPHFPERAYPLLPLFPERAYLLHPLYPERAYPLRPHFPERAYPLRPHFPERAYPLLPLFPERAYLLHPLYPERAYPLRPHFPERAYPHLPLYPERAYPLRPLYPEWAYLLRPLYPERAYPLLPLYPERAYPLLPLFPERAYLLHPLYPEWAYPLRPHFPERAYPHLPLYPERAYPLRPLYLEWEYLLRPLYLEWEYLLRPLYLVLGFPHLLPCQVWGFHLLQLPHSLHLGQESHRPLCFLYQALHSSHKLGVALYQPHRCVDFFLLHCQVACLD

SEQ ID NO: 2021 - protein, 181 aa, Homo sapiens
APARPGWEAPRTCWSAGWRVTAAVGCPQHWPPRRLGPPRLRMASRTCSQGERCWRSCSASRRTGLQKKQRSFAPGSLPWVFSFLLVIASGNRVIRMPRRMQLRLIKINFIPGLQLVNPHTHWTIQKGSFLGEFHPWGHHPNLPMRNTGSRMLKQRMMENLNLLFQKLPKNAQMLSRRKLLT

SEQ ID NO: 2022 - protein, 177 aa, Homo sapiens
APARPGWEAPRTCWSAGWRVTAAVGCPQHWPPRRLGPPRLRMASRTCSQGERCWRSCSASRRTGLQKKQRSFAPGSLPWVFSFLLVIASGNRVIRMPRRMQLRLIKINFIPGLQLVNPHTHWTIQKGSFLGEFHPWGHHPNLPMRNTGSRMLKQNLNLLFQKLPKNAQMLSRRKLLT

SEQ ID NO: 2023 - protein, 177 aa, Homo sapiens
APARPGWEAPRTCWSAGWRVTAAVGCPQHWPPRRLGPPRLRMASRTCSQGERCWRSCSASRRTGLQKKQRSFAPGSLPWVFSFLLVIASGNRVIRMPRRMQLRLIKINFIPGLQLVNPHTHWTIQKGSFLGEFHPWGHHPNLPMRNTGSRMLKQNLNLLFQKLPKNAQMLSRRLSSY

SEQ ID NO: 2024 - protein, 309 aa, Homo sapiens
PVQGVLGLPRLGSGAGRSPRMWKLQQGRRMDKGPARARTRTSIASIRLRSKRICFQTSSRRSACSSSSSSSSSSSSSNSSSSSSSRAPRSLQRPPLPSPLSPGPSWAWTGSCWGRAAGLGRPRAVRTPSRRCPRSPTCPRAWPPSPGSPSNRRPPAASRSPRRPVSRQRNPRPKTRPPPRLSHFPRPGRGRKRPEPPCEGLGTRMRRVRRMLLRMRPGALRGRSGPRRWERTPRRGWGKSRRRRRKDLTPPRPLPCPAAPRLASAVSSPTRSSPPATSRPPPGSSARPITPRLSPLIRAPGSRGGRNPP

SEQ ID NO: 2025 - protein, 55 aa, Homo sapiens
FILERSPSNVKNVVKLLTTLQPLLHISSFMLKKNPTNVKNVTKLLTDSHTLLNIR

SEQ ID NO: 2026 - protein, 97 aa, Homo sapiens
KSFIKFSIQIDTRQDILERNLSNVKNVMNHFACFYTYINIKEFILERILTNVKNVTKCLSGSQPLLDTREFILERNPSNVKNVAKLLSTPQPLLHIR

SEQ ID NO: 2027 - protein, 58 aa, Homo sapiens
PRCPSTPCPAPPRSTTMPSRPSPPQTTSCCPTGPCCPPHHHRRAPGQGSATASPARCT

SEQ ID NO: 2028 - protein, 42 aa, Homo sapiens
GSWLTRQGYPTPGGEKLQGARRCPPAVIAPLPQPSQCTQKIN

SEQ ID NO: 2029 - protein, 40 aa, Homo sapiens
LPGSVRSCCGTSCWRSGRWACSAPWAWQAVAWDRAWRWSG

SEQ ID NO: 2030 - protein, 121 aa, Homo sapiens
RPPEQLLSTSRQPSQRPHEPQPTIHFLPRPHTFPEPPVTDDDPDVQVRHAQLHPALPQCHQDHRHLRRRAAARPAPAAPPTTTAGLRARDQQQPAQPDAPELSRCPEPYGHEPARPAAPVP

SEQ ID NO: 2031 - protein, 119 aa, Homo sapiens
SSGAWGARSTASRPTCSPRRAPSWAPRPSRTSWCPTPFGSAVCPWTARWATSRHQAAWPTCPSRSRCQGWSRGNVANTITLTKFFPSMLGWPGSRGGVEGVGGGLCREWHLWKPDVLAA

SEQ ID NO: 2032 - protein, 109 aa, Homo sapiens
QTQPWRPHSWVPAKPPNCPSARAACQAPRTALLLAFGLMPLGAGAGAGASPESLPRSSYMSSPPTWPTRLQRQCCRAGPTPSSPTTSRTCPGPSLTRPLKCPPPQNRYP

SEQ ID NO: 2033 - protein, 21 aa, Homo sapiens
GAPRWSMKCLGTPRVGTWGSR

SEQ ID NO: 2034 - protein, 170 aa, Homo sapiens
ARRQQAPRSPSHLHCRRRHPRPLAVPRLLCPQRGLLRTAVRTWPPTRWELPAQVVGLGAPTLTPRRLPPPTTLCLLEETPAVPPALPCWGRQPPLEMGSAAWWAQRACPKSSWSIGNGPSRRCETLSDCCSAAERLSPSSRGPQEERVRGAHQHKPPLPPSSHPRPLPAG

SEQ ID NO: 2035 - protein, 134 aa, Homo sapiens
VPRRRERAVRRGKRARSQGQPGVKVWGASGEPPQPLTSPPGPLGSRQLPAACSRPSPSPTARTNPGRHHQSSGRQSRATHRGRTDWARPSPRGDPCSGPPRGAQLSTVLNLPSHTPTGRPRPRVTSSASSSGRD

SEQ ID NO: 2036 - protein, 266 aa, Homo sapiens
EARPRAAPLGRGAAPRPHRGEAPCRLPQGWRAGQRAAPHSATFWASPARGPSPPWTRHQRTHSWRLPSSLRWTPPRALGLELHSGRASQGLRPNPPPKSLASTGASRSHPPALPPPTIPHQAPPPGPQPRGPPRAGAPAPSSPVPIPNTRPVGPTPGLPLLRIASQVLISGFPPPSRNLFPKAAGPAAAPGEFPSSSPSRHCMGPAQNPSLRMWLGTHSPMGHWCLPSISPRERGRRRPWARALPTRCPPSLRPHPCPATRASQVA

SEQ ID NO: 2037 - protein, 126 aa, Homo sapiens
QSAAPTRNFHFLRIRRPPAHKKVKTPCGCFPVNREEGSSQSPAQQTSPTEGPLLQKLLAALLSIWPLTWHFRVTGLHLWMPPGLLVPVPAMLPRDILQAEQVGTSTPRQGGLALRVMSLHRRGPPH

SEQ ID NO: 2038 - protein, 124 aa, Homo sapiens
PKSFPKDHLQPRMGWGAREGPLAPYPRGTFQGRRTEPVGWTPARGLRTPSWPPQGPHPPGCPSCGTPQQPLTPHLLGAPWLPPGVCSLTASPAQASGSASPRVPPCLGPKCSRPPGQVPTEWRC

SEQ ID NO: 2039 - protein, 221 aa, Homo sapiens
EFQRIPEKRSCGSLLAEPPLLLWQGPSPPAWPSGLLACPALPPEMRHRQAGDSQGQTPRAGEPRPTPTLTGCPGATPRILQAILPASATGRARLSQLCPLSLPRYRVQGRTPPPAWKVRWGPAARSRRTQGPLRPGALVLPRCPGSPALPQDWAWEEPQPQAAQPVTSSLTPPKATEMPPTRLPRGTPSAPKTSNRGPVAIKRSLHLQRTASGRAKLHMGL

SEQ ID NO: 2040 - protein, 26 aa, Homo sapiens
APPYVSSSSQGLEWLRVKMASWACRS

SEQ ID NO: 2041 - protein, 184 aa, Homo sapiens
PTRSEVVSCHPTTRSVPRRLCLPSQLPWLMAEETARWTEPWRGQRTRLPQAAPGLFSSKLSLWGHLCRGREPEAKMRRERGLLSCSQGNAGPRVPVAGVPLTISRKTTYFRKRRRCPQATWCLRGGPEAPSTRAAPPSLRAARAHQRTGRQHPPPAKHSSSQCTQGRRWGAWHPGSWPVAQRMG

SEQ ID NO: 2042 - protein, 62 aa, Homo sapiens
TSTSGGGGSPSRSAACGGRERRDRRPGPSRAHCPANGAGWPCPAVPLGPARTGLLPGEAAPS

SEQ ID NO: 2043 - protein, 48 aa, Homo sapiens
LMVELLLAIGVVMKPVFIFLNYSTFFHLLSFFPFLISCLLAKLRLFFP

SEQ ID NO: 2044 - protein, 41 aa, Homo sapiens
RRLGKLSYKRRKTDFHLLKDHLQNSEKFFSFFWLIPCPLKT

SEQ ID NO: 2045 - protein, 27 aa, Homo sapiens
QYFQHFIFLTSFIIQKQDLCFLLFLRI

SEQ ID NO: 2046 - protein, 26 aa, Homo sapiens
SLSSFSSTILLFFIYSLFFLSSSPVS

SEQ ID NO: 2047 - protein, 21 aa, Homo sapiens
NSVFCGYLSLCVFSLEIHLCS

SEQ ID NO: 2048 - protein, 288 aa, Homo sapiens
PVPLETLAAPAHVVGGPRASWDPMGKTTRAAAPKGTSWTRVSWTVWTWMNARTPPVPRSVSTPLGASAANAGLAMSRAVLERGPVRMWMSVLWVARLAPRAAPTQMAHFTAPVRRATSWPGRTGLSARTWMSVWARGAPSATACASTHKGPSTVAACQAGCWPQMGSLAPWGLCLWDHHLGPPMRRTKERKKGAPCPVLQQPVPQGAPRAPPRLHPPQVDLRCHLTPPSHLPHSRCWPPVGPQASGGSPASITPQLPLAPRSLQVGTPPWPHKTTMALTGKSCFYSTS

SEQ ID NO: 2049 - protein, 51 aa, Homo sapiens
PGDLCLSKPLQLQPMSWGGHVRPGTPWEKLHVPLPPRVPAGLESAGLCGRG

SEQ ID NO: 2050 - protein, 18 aa, Homo sapiens
RGGWLLPLRLPTRIPAAG

SEQ ID NO: 2051 - protein, 74 aa, Homo sapiens
PVGKVTRTRLRVIISCARRRPPMCSTGAARAPSVSAPSMAATSTMGAATRTALKGGMAPSSAAADQDSGCWMTW

SEQ ID NO: 2052 - protein, 151 aa, Homo sapiens
TPPHAGRFATLVGGSGCRMPAWMWLTSLPPTVSYTSSARSYCPPEGMCPVGRGCCSSWTWCLPSASSGNCCSTMGWCPRLRLPLPTPSLCPPTAPWRPRATAVTWTQTQCGTMWSWGRPSPWKPCGRVDTATPSWALPTGSSSTTTVASLR

SEQ ID NO: 2053 - protein, 253 aa, Homo sapiens
GGCAQAMGSARTGSWAAGSATATRASMERPVRCVSWAATGPTAPECVTVPMGCARRGCKGTEAVSVTWAGRASAVTRKSPALSALGSATPMPTACRTRPEPPPAPVLRDTPAMASSVQRWTPAPTAMGAAPLMPTVPRWHLGSGHAPARMATWATGSCARKLTAVSSTTGAATFTPSASPLAPSRSPAAAVRVTAGMASGPASSWTPALRTMEDAAHMPPAKAQGMARGHVPATQPTPWGTASPAVPESAWSS

SEQ ID NO: 2054 - protein, 121 aa, Homo sapiens
EVAATPMPSAAMWAPGRADAPASWALPGMATSAAPSTPAGQAMAAATAWPPAGQWGEVSGSARAPLALGVMASAVMETSSGSWRQMPTSPSSTNGLRVPASRFLPTAESQPWCPPRLQSVS

SEQ ID NO: 2055 - protein, 121 aa, Homo sapiens
VAVGSVCAVQVLLGQPVNSVLLVPLGPIVKPAAALCMAAVMRALGALAPASVMKAGLGHAVRCNWSCSLCVPHPVHPRLCAVQATAVSAAWAMKGMAVCVQWQTCARTGMVAAVSTPTVAR

SEQ ID NO: 2056 - protein, 208 aa, Homo sapiens
RRAVPATATKPSWNKAAAKVFSGLTARSVLGASPTPAMAKAIAVMGSRAMGPASASQTTRASPATSARTQTSMESNARKTAAVSMVSATTAQAVGGCASRARVPLASVAGSATSPWGTVGPQGWPSTATCMPAVLARRVLPDVAVLMALRVMASPAHLATPAPTRTVEAAQRMLSVSLGPWAPTTAHATKAGVGMAASVWLLTSVSWT

SEQ ID NO: 2057 - protein, 90 aa, Homo sapiens
WDPGQWGLPLLPRLQGHRLPHLLEPKQAWRAMPGRLRLCPWSLRQPPRQWGGVPAGHVCPWLQWPVLQRVHGGLWAHRAGPALPPACPLC

SEQ ID NO: 2058 - protein, 164 aa, Homo sapiens
AAADGSAGSKWCRRPAALATGVPGAMNALGALRPHAMATGPAWMAWTGMGPVCARKTSAAQPARSAKTPTGSGLTANRCAAVCTECATMGHVGMEAACALLDTLAPTVIKSCPSARSCAVPRTPSAPQRLPAAGACPATHSRAVNAEPPTPAGHHPAHCWPSAR

SEQ ID NO: 2059 - protein, 32 aa, Homo sapiens
AWEAAATPRDCPTAWGAQTASPNQHQRRDPQS

SEQ ID NO: 2060 - protein, 93 aa, Homo sapiens
SGRTAASRTAAPPGRRRPSGSRQWPCRLRKRRRRRQQRRPPPPPRNSNSNSSSSSSNSSSSSSSSSSNNSSTTLMVPASLRCWRPRLAWSATA

SEQ ID NO: 2061 - protein, 49 aa, Homo sapiens
VKPPSLCRPGLGSCLPEALDSLIFPPLRWRTSLRSQPNSRSYLMGWPTS

SEQ ID NO: 2062 - protein, 47 aa, Homo sapiens
NRRSTLRRSCPGKNSTPLHPASIWRANGMPSHLSCCSSVQTLEIPSQ

SEQ ID NO: 2063 - protein, 111 aa, Homo sapiens
PSSLHPLSHSHHHPHPPARPACSNPWPPCWRDKSTVIGGLEQLFPPGLGPCPPLSIPLAPHQVLPPCRPPQRPLAPRAPHSPLLPRHLSSLPQAGPGPGSAGRAKSQSRAP

SEQ ID NO: 2064 - protein, 209 aa, Homo sapiens
PSQGCGVPCMEMPGAQSARVQHPQSARSSGTRCLTHIHTQLQRTPRTPLATGWSRLLPQAQAPAPQEQRAMAACLPPVPPEVTLERAEFRGRGWTPAFHQQQPPPACLTPLPGPLASPAPPPAAAVAAAATLVSGAWSRTQAFPALTITKLPRWRSLTMAAWGPRHTAVGNRSWGLPLPLPTYPCHLDLPHPLHPPVPASYAPHHPLPG

SEQ ID NO: 2065 - protein, 79 aa, Homo sapiens
KSSSLGLRDPPALPHHPSPIARASWGLRPPAFLWALRILTPLPLPQPQPPAVATATVAATAAALLGLCPFPHHPIWPEV

SEQ ID NO: 2066 - protein, 175 aa, Homo sapiens
KRSAGLARPLWSGWAGVPLTQPTQWTQQSQRTVGLSDCCPPHRPRRRLAGWRQCQAAVSGDRRSIRRSIGGTGGPVRTVWVVGPVRAGQRPRPRSPKKRAAGCWGTWTCRARRSRVVRSPGPILAGPPRPSHPQLQPLHQLLHLLPSPHPRQPLSLERRLGRKPQGHRVSAGPTC

SEQ ID NO: 2067 - protein, 174 aa, Homo sapiens
AVLGPGAPARLIPLLVAHGCLEADAQPALGSPRFLLPYPLHMAVVLGTPANHIMLQGRPLQDPSMGSWNPCMAVCRHCSGSQPSQGFGNSLGNCTSQSTIVRRPHAATTAPFDTEEASLSWGPALADCSRPSSGTFILAPASTEPRSCPHWSKCGTCYTLSTNGTMEPSGEVPR

SEQ ID NO: 2068 - protein, 71 aa, Homo sapiens
RVPGGQSWMISMHPIFLCTASCSDPETSCGLMRGLCTGCRPPAGATTLPGTWGPSPPISTSWPWNDTSGMR

SEQ ID NO: 2069 - protein, 138 aa, Homo sapiens
CTVGMDLINVSFVGKHSIVSVYILSMKELTLERNRMNVNNVVNLLVILLPIEYMKELTLEKSLMNVRNVGKHSIVPDPVTDMKGVTWERRLINVRNVEKHSCVPVMFVDMKGPTLGKNFMNVSSVGKHYPLLQVFKHT

SEQ ID NO: 2070 - protein, 48 aa, Homo sapiens
EKSGKTRTLNMSTKTPGETSGVSQKRKSMKLKKTVIVEKLLPQFQMTG

SEQ ID NO: 2071 - protein, 140 aa, Homo sapiens
LKVNTVIIAEQENEAEVGTEAEECDQEPMTEIAAEARSTIDTENRNTGEEDGHEAEREEHHQEDQEVKIGGEGGETHGAQREKKVKAETKTNTETKRVRAHTEKKILRVRKECTLKVVIIIAQITAGKKRLIEIKVPSQK

SEQ ID NO: 2072 - protein, 45 aa, Homo sapiens
QITGMYLRVQTEKMKRRRKLKTINLTAKRETSEEIQKKMTSIKTK

SEQ ID NO: 2073 - protein, 122 aa, Homo sapiens
RFNVLDVFLTLPLTINLLEELSLNYFLMCAPKHARTFVVFVQVKRGPGNQLRNHYIIRVVSFTELSRILWFKVVTSVKEMDEEGNLSMEDFLKTRVSLLNTTKNFSCQWPTEGRIQMVHSSS

SEQ ID NO: 2074 - protein, 37 aa, Homo sapiens
EKVLLKLMRRKGKTEREKGKESVIHLTPSLLHTRDDF

SEQ ID NO: 2075 - protein, 108 aa, Homo sapiens
FPNLKLRKKKRKGINHHHLPPPHLVTQIAQVILSPLLIPLIPKVLLKRNQRKEKRNIGKIPENTRKKRKSERKARRVHLVRVKLKILKHNPSLLSVQKRSLLYLKIDS

SEQ ID NO: 2076 - protein, 50 aa, Homo sapiens
VWLQGRNGSQDQIWGHRGPGTPPQKKNVFHSACSPFWKEEGCDDDRGSCT

SEQ ID NO: 2077 - protein, 41 aa, Homo sapiens
CVQVELQWFLPKVKRKSVHPVLEHQNFPQWTVHRKILMIMP

SEQ ID NO: 2078 - protein, 37 aa, Homo sapiens
EMALNMYTVYQLKQMFHLKNSILKNSARHWKTILINS

SEQ ID NO: 2079 - protein, 36 aa, Homo sapiens
MIPVVPQKCLLRTQCVLLFPKEQPPKLPLKETPAFS

SEQ ID NO: 2080 - protein, 25 aa, Homo sapiens
TKKRKTANYERQPREPTKMWHQSRL

SEQ ID NO: 2081 - protein, 21 aa, Homo sapiens
FKKEMLRKKQNLNHPCQSEAF

SEQ ID NO: 2082 - protein, 253 aa, Homo sapiens
SRAPGPCWSFPATPRSTGRTAGRRPGRPPRSPPVRPDRAPRPTDSGHRPTSERGKATNTETRLSKGGRESGLTWGPKRSRWRSPTPRAGRPRTGGESASAAETGAESGTGTGPGSGTDTGTRTPAGTGTETGRGAPTATESARPTGARSGTAAGSGAGTESASETGGATGTGPGAESGTETRPGTGSGAATARTGARAKRALGTRSPRPRGPPTLAPPRRPRRPGRAETLFKATFVRCVEQIAFEIATILDSG

SEQ ID NO: 2083 - protein, 117 aa, Homo sapiens
KAPEAAPLPLSLEVREDHPLVISWAQEGPILVSLKLPGALIPTSLKDPEAKRLTLCQVPGAFSLSSSKTRGSIHHQDSQTKGRLHPCSLVDYGGPHPFLKKMSRPLRDFTSRARPRR

SEQ ID NO: 2084 - protein, 27 aa, Homo sapiens
NLFCAQETSSRKKRDHSEEGSGGPCAE

SEQ ID NO: 2085 - protein, 190 aa, Homo sapiens
VTTSEYNSWVSNLPKNQTSRKQWRVRQDGRKADPTSTGRSGRSGLSKSSHSPAVGKEALQVSTLLCRRGCQHHTSWVAAASAPSSRTTGAKSAVIPQTCSPQPSHSSHNSSGSLHGSFLHRFVCFQNSITAGAHPADSLWKEEIIRPVRQRASRVHRRSPPGAQNHSRGRGAGTSVVRSDRPAVRSVLKR

SEQ ID NO: 2086 - protein, 342 aa, Homo sapiens
CLHHQSRPCPRQSCSSKSSSLQTSPPHCPPPARRQTTGTPGRRGAWPLRPVRGRGSLSPGSRHVVPRVPCPREMLPGVASWARRPCQSRRKKSQPLPPGLRAKSPQRGPSRTAGRQSLGRAPAPPRLETARPGLPGGCCCPHRLAAPCSPASRCSTTVRGTLSPARGSRRRTRLSAQPSMRTQEIFILLEGAAALQVKQRGTESHRPDPARAPPRSPHQDRKWGALSPRFRVSGNLDLMLWGCQGFTAPISRDQGGQPLRFQKRISLLTMGHEGLRQPDSEPRRGPSLPYSRGNMGHLLMGTAEAPHPLTLVDHEEWHHPNLKNARIPMGRRGSSRTPRITR

SEQ ID NO: 2087 - protein, 59 aa, Homo sapiens
MNKEILKVCLNLPKRLERQINMIPLVLPQIKTSLPIETKKLTMTPESIQVPNVEMKRMN

SEQ ID NO: 2088 - protein, 54 aa, Homo sapiens
VATIQKSFQQEMVTIRRIIQSQKRRRVKTLQEMVKEISIRNTEKEEKGRKVRVF

SEQ ID NO: 2089 - protein, 52 aa, Homo sapiens
VRQPKKSNSTEKLGRKLEVQKIYQTQKNPLKNWSQHLAKLNKKKSKERSDEK

SEQ ID NO: 2090 - protein, 99 aa, Homo sapiens
AGIRATAAPASAPAEATVLLEARPEATVAVPAQQKVRTARRRRKRRKRKNTRNIKSIRSIRNMQALKWNWKKAKNTNTRKRSQRRTKIKRRRRRKMTKK

SEQ ID NO: 2091 - protein, 85 aa, Homo sapiens
KHIMGEVLTLETHLKKNATENGRENIESGMKNIIKVMLLEHSLDPQQIERTFLQRDFCHLTSGILPSQEAAEKTMLVGKVIEVET

SEQ ID NO: 2092 - protein, 66 aa, Homo sapiens
QDEKTLLLGIKILHLDRKINQGKREICLKKEQEIPKKVILVPQETENLMITKPLMILNGQMKRQNL

SEQ ID NO: 2093 - protein, 64 aa, Homo sapiens
MENVRDLLDLNLQLKKPKRRLRRLTILNHHLPLRRMKKSLEPPEKLTLNQQKNTKKQNQSKRKK

SEQ ID NO: 2094 - protein, 40 aa, Homo sapiens
DLKKLAANRYYLKTHFQRNSFFLKCFFQIFKKLKQNLEIL

SEQ ID NO: 2095 - protein, 39 aa, Homo sapiens
LLGSICLLLIKLDHFLTIYYRMNYNTLKMQIIISPHAKQ

SEQ ID NO: 2096 - protein, 32 aa, Homo sapiens
GLLFFASFFGDWAAISCEWPLCTGFSQKEPVA

SEQ ID NO: 2097 - protein, 32 aa, Homo sapiens
KTKPVSKKRMLCKWQKKLKPYRSVLVLIKMFF

SEQ ID NO: 2098 - protein, 23 aa, Homo sapiens
GAYMNSSVQKKGNFVFSCEGLLL

SEQ ID NO: 2099 - protein, 23 aa, Homo sapiens
MHLYNIRLLKNIFIHHYQVLFCR

SEQ ID NO: 2100 - protein, 22 aa, Homo sapiens
KNGISLVLIQHYQCYRTPLFML

SEQ ID NO: 2101 - protein, 105 aa, Homo sapiens
WRVRKWGDLQRITPHEKDMQQKSKKRKQLYIQNALNLSRPHSARLTASDTTRTRTCRTWRRSSASAASAWRRSFAASCTRGTSCTPWRAKISTMSTYREKLSGFP

SEQ ID NO: 2102 - protein, 95 aa, Homo sapiens
AAASAPGGDPVSLTSSSSSNLAKKISFSGKSGGPGRTPRTAWRWPTSPSGASSRNPRTNCPRRPPRPGRATTPAPAPPPRDPAPKGPRARRRRRR

SEQ ID NO: 2103 - protein, 91 aa, Homo sapiens
ARSSTTRSRGRRTAWPTRTSSPSSRSLRARARSPSGPRASASVPTASARGSTAPPGSCGTSWGPACAARPVSSPGPHPPCPRPSVSRWSAM

SEQ ID NO: 2104 - protein, 82 aa, Homo sapiens
VDASGSNLAKKISFSGKSGGPGRTPRTAWRWPTSPSGASSRNPRTNCPRRPPRPGRATTPAPAPPPRDPAPKGPRARRRRRR

SEQ ID NO: 2105 - protein, 81 aa, Homo sapiens
TASLRIPGWRWRRRPVISSLRRRRRRTRRARAGTGHPNRPPMAPLHPPARPLRTRRPSGRSPKHLPCDSSKGLCLMSRRKV

SEQ ID NO: 2106 - protein, 74 aa, Homo sapiens
WRQRKTLEEDCARLTASDTTRTRTCRTWRRSSASAASAWRRSFAASCTRGTSCTPWRAKISTMSTYREKLSGFP

SEQ ID NO: 2107 - protein, 133 aa, Homo sapiens
PARCQRKKTRAAALLRPARGLLRSKRQSWGSRTLSRRGAAHGSGGERAAPRPLTGLSSVPSSRPWLRSGWAAWGLLTPTSPCALRRSLGSWSGSVHGGGRSAASASGCSTPQTGQALRMQPCAWRWTGAQGCL

SEQ ID NO: 2108 - protein, 45 aa, Homo sapiens
SPPSSSPRRLGFPPVSTPKSQVTGQEVHGALRDARPAEFQERLAD

SEQ ID NO: 2109 - protein, 85 aa, Homo sapiens
RLRRSISSGRRPRRSSVGGWRCSWSIPGPTSRIRRRNGKWSPPHHRSLGLPRWLLPAAAAAAAAAAASPVLRKSPPPSPHSGRKK

SEQ ID NO: 2110 - protein, 78 aa, Homo sapiens
LKSLRPWTLRRQSTWRPMQWGPHHPATHARAAARRGRSLGSGTSPMKPPQLLSQTPRLPPCLHTEEPSHWTGGPRSPP

SEQ ID NO: 2111 - protein, 36 aa, Homo sapiens
IHTVHTTERTRKTIKNAITITTKKKCPCRTLQTSSY

SEQ ID NO: 2112 - protein, 20 aa, Homo sapiens
LYILLQIFFSSILIKMFAYW

SEQ ID NO: 2113 - protein, 84 aa, Homo sapiens
KLLKKEAKKNLDLQHQRRRKKKKDKVEIRNRSPKANSTECQGEHSREQNLLNLVQLNPHSPHHRKDEEDHQKRHHHHNQKKMSV

SEQ ID NO: 2114 - protein, 70 aa, Homo sapiens
QKLHYKFSKTQEAKLKRIFHTSDQPCFLFYITNLKKDPPVKPNMPFIVSMRYFLVKRPSLHRYLSLCIRA

SEQ ID NO: 2115 - protein, 131 aa, Homo sapiens
NPRSRAKGCPQASALSSRRRLPPGGASGRSCPEPRVPRCLGPHGTHSPRATAAGRHPGAQPSPPWLRPRRQAVAMTVRTARVSWGQRHHPGKQGCCCTPGPVWPCWGPHPPLWSRWRPTRRPRRRRRGRGC

SEQ ID NO: 2116 - protein, 118 aa, Homo sapiens
AGPRWRRPSGRRWQRPARGRGCCRTSSSSTAAARSCGPARPCSPCTAWPHPYLATASAPTPSAAWPAPTRPSSGGPGRASPGEPTSCCGLRRPRGWRPRRVGGGGRAVSSWSSWTTRV

SEQ ID NO: 2117 - protein, 117 aa, Homo sapiens
SRTPNLRCQIPHGGLRPLPGPPWQPLAELVRGGADQAEGGGSGQQGAGGAAEPLPAQRQQQEAAGPRGPVPRAQRGHTHIWQRLPRRLLQQPGQLLRALRRGDRAGPPQGSPQAAAG

SEQ ID NO: 2118 - protein, 180 aa, Homo sapiens
RGYKNCNVRPSWRQGAPRPPARLILLREGHEKRGAGRRGSRGPRQGPPPKSWSSEQGVRVPLRTRGSSRPLRRTSWRKTSWGSRAWRTQRRTVAELPTTATHPGRYQAWMPWWPPPSTWGTCPATAHRTLSPQRPLGPPAQSPCLIAQGFMGSLCSASWLTWQSSGRGVRGLCQRRKRTC

SEQ ID NO: 2119 - protein, 171 aa, Homo sapiens
CRAASWAGTQPPTPTPIPPGCPAPAAPPCGWGGTPTAWGTLPCTRTCPPASPPPWLALCPLSSPSHRTPPHSWSSCPQSPHPTAPPTHLRMSWTRRHCGPPCTGAGAPPLTCSTRASSLCTRGRSSSGSRSSMLCSSRGPPSSSGSPKTSTWIWRSPPRRRPQSPPTSQLP

SEQ ID NO: 2120 - protein, 322 aa, Homo sapiens
VPGQAGPRGCDLPQEQDLQGVAHGGQGLQPQARAAPAQPQLCAPGPCGQGQEGAGTHPPAAHGAGAAQVRGPGRVPAALRQRLPQLLLGRGRGRAGAGGRRALPLPRPPVRVLFLLWLVHLLLLRLRVHLQPLLLRQRGLVLQLRRRGPGSAAADLPHPPRAHPPGPARGPALQGQRPSRACPALLPVQGHGGWHRCGLRPQQQQQIQAQAQRGPELLQSQRALPEAAAALRGKPAKDLSLPARPAALEVVGESHTAAWHEGEGPEAVLQGHRAGRGDPACRGLCRLPVSWAAQPPLHRPHREHVGVVGQQHGGQGQVVLPP

SEQ ID NO: 2121 - protein, 309 aa, Homo sapiens
PPGACQPRAAAAGQQRPRRVRPDPPTEQLPWGPGPPPHDAERPAGRGPSPPHPPPSPLAAPHPQPLPVDGGALLRPGAPCPAPEPAPRLPRLRGWPCALCLPPPTGRPHTAGHPALRAHTPQRPPRTCGCHGPGVTVAPHVRGPGPRLSHAAPGPAPCVLEAAAPPAAGALCFAAAEGRPVPAEARRPAPGSGGARPGEGPKVHPQASCLNPHGPGRPLTRCRPHQAATLLPSARPKAPRQLPHPTTSAQRPVHFKCLPCQQPRAWLPGAQRRGKEWGGSAVHGRHHHIRTSGTCSLCCPRWSRIPGLK

SEQ ID NO: 2122 - protein, 141 aa, Homo sapiens
QNLVIQVVPVEATLYPVFMQGSHLRNMPQDTTDHICILLIVASQHLHFLHLIRLLCIALGYYSPHHHLLRHQPWSQATMGLLTSPVTAIRLLAILLRLLWGLGTALGGHRLRLQRTCLQEFLLPPPYPPPLFLATPTRAMV

SEQ ID NO: 2123 - protein, 46 aa, Homo sapiens
HICSDCIQPTKKICREVFRHFGRSCGPTRTQQLFGHTIRTSERSEK

SEQ ID NO: 2124 - protein, 114 aa, Homo sapiens
LSSSDCCGVWVQPWGGTASAFSVPAFRNSCSHPPTPHHCSWLHLPGPWFDTYCTVGSDKQFSKFSQKESFLHGRARRYGLQLWKLQLWPTEIYTESYVQNARQQHFKHKSGEWL

SEQ ID NO: 2125 - protein, 29 aa, Homo sapiens
KNMQRSIPAFWKVLWTDPYSATIRTHHQD

SEQ ID NO: 2126 - protein, 45 aa, Homo sapiens
RHRNCRHFGWMCPIHRCGAWRGIVWHRFWIYFCIYHTFHSEYLCN

SEQ ID NO: 2127 - protein, 38 aa, Homo sapiens
LYTLLYLFRESQLALWSGTWMLKKPIKKNPSMKSFIFV

SEQ ID NO: 2128 - protein, 97 aa, Homo sapiens
DPNLCFMQWMRRVSLEGRVRARPLWLRFGRGGQLTMDTAGTITGPIVLCSKKNSVIVHKIVLVFLKSLSSYNCERRISGIQKRAIEFAVLKLLNMDL

SEQ ID NO: 2129 - protein, 90 aa, Homo sapiens
NPLSLRHPGNHSLRSNNEKVRGRKRVPDIIHDHQVLHEDAEQRQRDLDLHLHGCVHCGQESRVELGLHLLHPGLLPNLESHQRICSLLYQ

SEQ ID NO: 2130 - protein, 51 aa, Homo sapiens
CARRSGPLTPASSCGAAILTTPTFARPRRGPPWTGLCVHLASIVLKDTASG

SEQ ID NO: 2131 - protein, 128 aa, Homo sapiens
RSGLRAPSPVAEGPSSPSMAAAGGWTTRWYTVASVPPSRSPKPSAERATHRNAPSQCGSQANGSHVARPVGGQACRCAPCAAFSRYTTTPPAPCTPSTAMTPGPRAAGPAAASSALVVGEPGPGPSAQ

SEQ ID NO: 2132 - protein, 32 aa, Homo sapiens
PWRCGHHQAPPWRSLSMPPAPMPQRITQKPMP

SEQ ID NO: 2133 - protein, 106 aa, Homo sapiens
CARRSGPLTPASSCGAAILTTPTFARPRRGPPWTGLCVHLASSGRARWLMPVIPALWEAKVGGSPEVRSSRQVWLTWQNPVSTKNTKISWARWWVPVIPATPEAEA

SEQ ID NO: 2134 - protein, 64 aa, Homo sapiens
SGWRRRSSSSNPWRRGWRRRRLSKAVCMWCIAGHPRPLLSGGHRPWTQGPPWTAWTASAAPWAS

SEQ ID NO: 2135 - protein, 38 aa, Homo sapiens
RDLILLFSGKKGTSWLLPTVLGLFSFFMHSKMIVISTW

SEQ ID NO: 2136 - protein, 109 aa, Homo sapiens
RKSLRIHHLVLFVLPLERFLQDPLQISLSGKWSKIHLEKLVNHVTECPVESCGMLPDKPGFFNHAEQTGCFFDTNITGFRVKIAVFLSLLWHNTLRVFFIAGLPTGRLD

SEQ ID NO: 2137 - protein, 28 aa, Homo sapiens
FCFFLGRKGHHGFCQQSLGCSAFLCIPR

SEQ ID NO: 2138 - protein, 24 aa, Homo sapiens
AAKKFCSIMTNKIRSNPIHLWYWT

SEQ ID NO: 2139 - protein, 15 aa, Homo sapiens
RKKQRKFKENTGTTK

SEQ ID NO: 2140 - protein, 13 aa, Homo sapiens
TKKMGNSFSKENP

SEQ ID NO: 2141 - protein, 38 aa, Homo sapiens
MGLGHMKKNWMTMQTIIKTRSSTLERNRTEAMPREHLL

SEQ ID NO: 2142 - protein, 213 aa, Homo sapiens
DYSNKRTFTLQGSQTLKLSMGYPFRVEKLITSVESPQYRLATNTHLSFTRDFSLEKDLMYAVILGNSLAKVIVLIIIREFALEKDLISVDNVMNHFGIRPTSLNTREFTLEKDLMSVENVINLLVISTVLLTISEFTLEKDLMNVTNVGNLLAISAALFTTSEFTLEKDLISVENVGNRLITSATSFSISEFTLEKDLLSVRHVGSYLGATPT

SEQ ID NO: 2143 - protein, 170 aa, Homo sapiens
RNTREFTLEKDPMSVKNVGNHLGTSHTSLNTREFTLEKGHMSVENVGNVFIKRAVSFNISRSTLEKGHMSVENVGNVFIKRAVSFDISRFTLEKGHMSVENVESVFVKRETSLNINEFTREKDIMNVENLADLLVKRAPSFNIREITLESTYEYGECAKSSSQKVGLIQQ

SEQ ID NO: 2144 - protein, 46 aa, Homo sapiens
NCRLEGLAFSNSEPRGNARVDKQNQLCGSCIFCTTISSSNRLSEEV

SEQ ID NO: 2145 - protein, 124 aa, Homo sapiens
LRMFGMNPGKLLQRGLALARGHFPLCVLMRVERMKSSYRKTNSILRRHLNQRETGKGSANKRSTLRGKMKTSLGLDIRRTPPTCTAPSLKPFWTTLLYTTVQSPWRHYTQSLIAILALKCPSLQ

SEQ ID NO: 2146 - protein, 28 aa, Homo sapiens
SRSPPSWPSTAHIPPTRRSKPRTSMSTN

SEQ ID NO: 2147 - protein, 78 aa, Homo sapiens
MMKRKKSLPQKVLRRKLTEHIQRPSVVLEVLLTHFWTFLMIQMLLCTKVDSWLGKFMQIWMERRLQEENEDGKPFMLY

SEQ ID NO: 2148 - protein, 129 aa, Homo sapiens
GKGMSSVGRKRLSGPGPRRSSRQPVMSSVWEMMSTLKRPTIPSSAMIAAGRETSSASPLWPKLQNSHKVYPMSTKSESQLPGSLAVKTSRALNPVGQLSSCVSTPTGARSCSTSLGTTWVSSLATTRTS

SEQ ID NO: 2149 - protein, 43 aa, Homo sapiens
VPLPGGLPCRLGVDRAPHVRKHHPCVPPGDAQLPAHPLLRIPA

SEQ ID NO: 2150 - protein, 87 aa, Homo sapiens
PLLTITPPPSPSLSTWRMSTAAGGAALPTGCGSCPPCPEASPLCSTRRCSTTGSPPPSNTSLIPGTRMSGKAPTGPPQSGEPLASRS

SEQ ID NO: 2151 - protein, 86 aa, Homo sapiens
HSPWVPPPKPWICPTSHRPAKNSPWQWMGPRVPGMGLSMPTMMGRRLAHSPMPTAWPPGPQARTPRRKQPESASKAEGRTMNCSRR

SEQ ID NO: 2152 - protein, 174 aa, Homo sapiens
TKRSTPLALTSSRTQSSSMGPSTPGGMPRAVWAGSSGPSCRYSMPVTAPRPTGCSTTSVTMSSMPPTKGTSGLPSPYSPRGQTASTTSESGTPSSSATLATSSLTAPPWGTQPMCSSQRYAYSRAGNRLEAASMSCRSCFRPTAMTLSSSRFLQSWCWKFPSGTPSLSGSRTWG

SEQ ID NO: 2153 - protein, 274 aa, Homo sapiens
VTGYLIGILVFTREFTLERNHINVRYVIRASVRPQIFKPIRESTLERNPTNVMCVIRTSAVIPTFRPIRESIQERNPTNVTHVGRTSVRSLIFRPIREFTKERSHTNVRHVGRALVRVRISKTISKSILERIPTNVMCVGKASVGVHIFKPIRESTQERNHTNVKNVGKASSGTHIFMFIRGSTRERNPINVACVVRASVRLHIFKPIRESILERNHTNVLCVVRALVRVRCLQIHQRVHDGDESINHDECDRGALQDLDFPFSSENPHSTEYL

SEQ ID NO: 2154 - protein, 127 aa, Homo sapiens
HLAKISPRQLLAPTSSPWANLTMLQGPARIHCAELLKNPLQHPRNRATHLLATPGARVLQEHLSIHPVCHQSHPPEAPLLPPSTRASLQASPPPPPSSQHPGGTPAACLQSKLPITHRRSPLRRPRH

SEQ ID NO: 2155 - protein, 34 aa, Homo sapiens
AAISHPSPDSNAPQYSAPRKTEPQSASSSDPGRG

SEQ ID NO: 2156 - protein, 31 aa, Homo sapiens
RMDTSCKCAGSRQKTSRLVENMSEVATTKFC

SEQ ID NO: 2157 - protein, 25 aa, Homo sapiens
RRKVLPNRRTLYLQLCQHQGETTVR

SEQ ID NO: 2158 - protein, 82 aa, Homo sapiens
IESTYPPLSSRHFRPQMAAPWCPLAQSPLPRALGLKAALGVGLSPLPRAYWSRGRAQATAVLPNRRTLYLQLCQHQGETTVR

SEQ ID NO: 2159 - protein, 69 aa, Homo sapiens
ENRTPVCQLLRPWQGVTLKLHSHMLEPYRDRDQYQSQGTGPACPHPPNLLVSTQLGTAASPTQHQQLPR

SEQ ID NO: 2160 - protein, 43 aa, Homo sapiens
TIFAFKSSCTIYPAMLPFQKNSCTKERRVYADAGILYQTASIC

SEQ ID NO: 2161 - protein, 42 aa, Homo sapiens
KIYSYPTSTGAWLASTKKIFRTESQNSTSSLHCSCILSPECC

SEQ ID NO: 2162 - protein, 40 aa, Homo sapiens
EDEESSCYNSDSFPSLYFCHESSSILPENTLCCHCAAVCI

SEQ ID NO: 2163 - protein, 32 aa, Homo sapiens
ERDLCSGRFSGHEHKKTDSGTAPGCHYYSEAL

SEQ ID NO: 2164 - protein, 31 aa, Homo sapiens
RQQIEPLMYEVGPKLLTVFTVSTNLQLINIK

SEQ ID NO: 2165 - protein, 29 aa, Homo sapiens
KGGEFYSVFLRRPCVMLPDPPLPSLLCAI

SEQ ID NO: 2166 - protein, 22 aa, Homo sapiens
KNRFRNSTRLPLLFRSIVKPLK

SEQ ID NO: 2167 - protein, 17 aa, Homo sapiens
KGIFEPKKCYNKIAVNC

SEQ ID NO: 2168 - protein, 84 aa, Homo sapiens
VWPASISPTVASVLWNREVVSPHLGLRGPGVPPAPHQMLPAILCTPETGPPQIQGDRGPWGSPQGQPLQASCTHLTLICTVLHK

SEQ ID NO: 2169 - protein, 79 aa, Homo sapiens
APPVPPLFLPLLSAVPCWATLRNHCCEDVLHHLATLRASQQKLELVGHTAPSTSRCLSLSHSLMFLSKMPRLPSWASWI

SEQ ID NO: 2170 - protein, 65 aa, Homo sapiens
CATCRRSRLHPQSRRLALHSLQSGRGPSRVACSWATAQQGGRHPPGSTRYPSFPLRLVPLSLIGP

SEQ ID NO: 2171 - protein, 144 aa, Homo sapiens
RMNPLLPHGWLTSHPGCPRTDPSPLHPSPQLLVPPHLPRNPILLHPSLGAQPSMTVWWLQCRRGQLSWKVGHTPPWGRTTARLKGKGKKKVGLRLLTKAHTAQRYQRPAKAMPPRSLSRLSRSRESPHPILMREAFSMQTSMSR

SEQ ID NO: 2172 - protein, 134 aa, Homo sapiens
LQLQACLETWVMASCRATWSAQRQPRRSQAPSRFPLRIVQPMAQLKPALTPQALPQPRLKMKRLRLALPGNVGPGLKELRGAPGLTHCSPLSSQCVLQGAPGAHPAVPLLRSKLGPRDVPLSLGPIVGSSPHPS

SEQ ID NO: 2173 - protein, 33 aa, Homo sapiens
GFLPKTYAGTLEGNSKEPGGFWGSGIGTPGQGP

SEQ ID NO: 2174 - protein, 94 aa, Homo sapiens
CLLGLALHAPLESLHLEQLGIGPHASQPRRQLPAETHLQRRSFHLLSHPRASSLTLQPSAMQPWQDPLYPQGQSQGQVWSPASPHLQFPPVLLS

SEQ ID NO: 2175 - protein, 63 aa, Homo sapiens
GKSTLKKRYQSWKKKKTRRKKRSKRRGKSSRRMKEGRRRRRMPRRRRRGKIPNLSSRRFPSQT

SEQ ID NO: 2176 - protein, 148 aa, Homo sapiens
TDWAGRVNCRATAAATSWSPPAWGSPTRGSPPWTPWPLTVPQPTNSSLNDARGSARQRAPRRGGPKPCHCGSCSGQPPAQCQPTARPRHPPASRPHSPEPRHGHPCATSTVRSQPDISPPHPLWTSRFQEQPFPHHWDPPQPGEFITT

SEQ ID NO: 2177 - protein, 128 aa, Homo sapiens
CQGQCQAAGTQAWRPKALPLWQLFRATSCPVPAHCQTQAPPCLQTPQPRAQARSPLCHLHSEEPARHLSPSPPVDITVPGTALPPPLGPSPAWRVHHYVRKAPSAPPKPSPCLTEACIFISDYSRTSV

SEQ ID NO: 2178 - protein, 126 aa, Homo sapiens
TDWAGRVNCRATAAATSWSPPAWGSPTRGSPPWTPWPLTVPQPTNSSLNDARGSARQRAPRRGGPRHPPASRPHSPEPRHGHPCATSTVRSQPDISPPHPLWTSRFQEQPFPHHWDPPQPGEFITT

SEQ ID NO: 2179 - protein, 36 aa, Homo sapiens
QRQRETNRHAKLWAAHRHVHKKECSLQEQGCSQCHS

SEQ ID NO: 2180 - protein, 106 aa, Homo sapiens
CQGQCQAAGTQAWRTQAPPCLQTPQPRAQARSPLCHLHSEEPARHLSPSPPVDITVPGTALPPPLGPSPAWRVHHYVRKAPSAPPKPSPCLTEACIFISDYSRTSV

SEQ ID NO: 2181 - protein, 106 aa, Homo sapiens
PAGDHHHAIFLASRAGARIRRSPKPCHCGSCSGQPPAQCQPTARPRHPPASRPHSPEPRHGHPCATSTVRSQPDISPPHPLWTSRFQEQPFPHHWDPPQPGEFITT

SEQ ID NO: 2182 - protein, 179 aa, Homo sapiens
LTPSVLTSPLLLTCMGITTISRSPRALSPHLTCLCPWRTLYILTCRRPPPCHLPCLSGRGSDPPQPKALPLWQLFRATSCPVPAHCQTQAPPCLQTPQPRAQARSPLCHLHSEEPARHLSPSPPVDITVPGTALPPPLGPSPAWRVHHYVRKAPSAPPKPSPCLTEACIFISDYSRTSV

SEQ ID NO: 2183 - protein, 66 aa, Homo sapiens
SLLLLAVGPLQEVWALLNRLGRQGQLQGHSSSNQLEPPSLGQSHQGFPPLDPMAPHRSPTNKLLPQ

SEQ ID NO: 2184 - protein, 64 aa, Homo sapiens
TDWAGRVNCRATAAATSWSPPAWGSPTRGSPPWTPWPLTVPQPTNSSLNDARGSARQRAPRRGG

SEQ ID NO: 2185 - protein, 153 aa, Homo sapiens
MGREKLPSPGVGPRRTVLQMLAWPALPAAPVSATPPGLAWSSDGCLWGAMRRSPGSPVGPPRCGPLAPAPTLQASVTLPLSSHPTAPLLSANSCHSSSLPNQLVSGRMPPFSGTPHSQILICFLKMESKQGTVLMKLLRILLQQLWRGGKRRG

SEQ ID NO: 2186 - protein, 149 aa, Homo sapiens
GAGGGACSLPRAPASPLFACCSLATCCSSLSLRVGSGYRFWTMPIAPWSRPSRFRIHLDPLPSASPFSATTRAAPPTDYSKLLPYQTCSAGWEPSQPQAPFPAPQTPSMRTVTVPRNCVQSRLHLPRLKDGVWSPGLPPNTCTRPLKVG

SEQ ID NO: 2187 - protein, 24 aa, Homo sapiens
VRVPEGGRALCLAPPLHPSLPAAL

SEQ ID NO: 2188 - protein, 180 aa, Homo sapiens
CQPSPFLQQHPPRRSPLGSSAPALLLVPGLPSPQGLPTMAPLHKNYPETPMMHQPQCAPPSSGSPQLHPSSPLLFCPPQLLEPASTPRLPQTHLPAPPHLVQCPGAPPPQNLLPGLQSPHPSRLGHPARLCSPWLESWLRMALPQLLALCGGWLAGLKGVLKAGLRMQMPRSQVSKREQM

SEQ ID NO: 2189 - protein, 49 aa, Homo sapiens
IKCRRRSKQPSEQARGFKSTLAKCFGKNRTKEAAAGWCLAPGQRVPWRN

SEQ ID NO: 2190 - protein, 43 aa, Homo sapiens
LLDLGGLIKTYLPKLFRISLTKWFSFGRTYTHWWKRGKPNYWM

SEQ ID NO: 2191 - protein, 29 aa, Homo sapiens
GNINQEGTIIGSTSNYTAFFGKTWRQNDR

SEQ ID NO: 2192 - protein, 18 aa, Homo sapiens
KKQQKKFPLYSLLLVQRI

SEQ ID NO: 2193 - protein, 53 aa, Homo sapiens
SHGRISYLAKLWKLSQVFLLSVPIRYFCSCKKNHYSERLRATDDKHRKAKSGG

SEQ ID NO: 2194 - protein, 14 aa, Homo sapiens
LQKKSLFRETQSNR

SEQ ID NO: 2195 - protein, 44 aa, Homo sapiens
GAAEAPHPEMGAVFPVHRPHRGHCCWPGCPSSCGHRSCGRCCDV

SEQ ID NO: 2196 - protein, 41 aa, Homo sapiens
CVSHSLKSLRQLSCEGLRCRISSRLPFVTSRASGISFCKGT

SEQ ID NO: 2197 - protein, 30 aa, Homo sapiens
GHPEVLGPGFLPCGDHTDLAAGWRGPNSGH

SEQ ID NO: 2198 - protein, 18 aa, Homo sapiens
CWSWRPEPSSCCSRRPWP

SEQ ID NO: 2199 - protein, 73 aa, Homo sapiens
SRRGRSIGTGTHRSTRPRHRLTERACGTCAATTTRARPGLTPSRACTAATWGRTGASSAGMTSTPTTARITSP

SEQ ID NO: 2200 - protein, 121 aa, Homo sapiens
KAHSTSVCPHHPTTLTFCPHPPGPREKGTGSPRPSAARCALHRTQEHTMAILQASLPILPASTRPSLEPKQTAVMVPGETLVPKAHVYSKRWLVYTLLIRWGQSFQFHPQLFLSQVQQFQR

SEQ ID NO: 2201 - protein, 29 aa, Homo sapiens
KNCSTTRATGAGGKKHSSCGFCCERGHKR

SEQ ID NO: 2202 - protein, 79 aa, Homo sapiens
RLSLFLSHPTRCPITSLPLLPVPCPTASTTLAAPAPAPRSPQPPLTCQSLGPCRTPSMMPPPPSACTRPQSTCARRKVS

SEQ ID NO: 2203 - protein, 73 aa, Homo sapiens
KAHSTSVCPHHPTTLTFCPHPPGPREKGTGSPRPSAARCALHRWLVYTLLIRWGQSFQFHPQLFLSQVQQFQR

SEQ ID NO: 2204 - protein, 54 aa, Homo sapiens
RDSRLAPTTSWMCSSTTAPSWARPRPLHTCFCPPVGLQPPDTSTPRPSQTPRSS

SEQ ID NO: 2205 - protein, 138 aa, Homo sapiens
PAASELVLALGARATGGRRFPAAPVGRDTGAGAAGERLIPPGPHCPPDGTHAWHPLPAGCAALPLHPPGPGLAPCTRASAPQWASSPPTPPRPGPLRLRDPADMEAPGGSAWANIQVRCGGAGGWGCRRPTVDRRGQA

SEQ ID NO: 2206 - protein, 207 aa, Homo sapiens
SGRATDPTSTPWTGMKPRMGGSCCSSQMCSHHRAASTVPLTWKPAPWAAPSFGSSCGVVGLGAGGQAVPRSAQVAYMEVSATTMTANVYAPLASLAPAVNRPAERAVLGRAARSSAQAYQAAGASPSASQTPMAALVDLAGEEASAKKLVPLVILGLIADSSASVRMVALVTGSVVVSAPLGGMECTVRSQTGSPRSSTWPQNWSST

SEQ ID NO: 2207 - protein, 68 aa, Homo sapiens
SPGWAVPAAAPKCAATIERHLQCHLPGSQPPGQRLLSAHRAGLWGWALGARLYQGVPRLPTWRCLPRP

SEQ ID NO: 2208 - protein, 58 aa, Homo sapiens
RMHRSCFFIIGNAPQHADFTLAIRRRGILAPRISCDPDAVLQIFVSQRARPCLHVDEP

SEQ ID NO: 2209 - protein, 121 aa, Homo sapiens
DSTWAEVLVGDRRSGRLTEMLVIFLVFQSFSHSFLNTLMSLPSIFSSWPCFCSSQLVSCLRTCRSVCLSSAAGVSRVASLIWIPFGHSSLEFLPPAELWSLLSITYAQKLFFYYWECSAAC

SEQ ID NO: 2210 - protein, 22 aa, Homo sapiens
LTLMMKLDLQQKSLKRLQQTQG

SEQ ID NO: 2211 - protein, 71 aa, Homo sapiens
QPHMTSDFMGHQLLQLLLNLTHHLKGLDVFFCPVWPLIMLLQIIPSQQVLLMGLWSVALVLVKDSSLLPPA

SEQ ID NO: 2212 - protein, 31 aa, Homo sapiens
PPSRLGLSTERDLPLQSPKERPPLTASPFLL

SEQ ID NO: 2213 - protein, 27 aa, Homo sapiens
ILNVLYRPQKGLVSQKNLVACPDLRRQ

SEQ ID NO: 2214 - protein, 76 aa, Homo sapiens
QPPGTMSKLCWVPCQGTSCSQHSRPMRGVWSRWEERDAEGHSHQAQSRPSRRTARSSAPRRSGQGECRVWIRVAVL

SEQ ID NO: 2215 - protein, 46 aa, Homo sapiens
HPCLPQRLLPRHLPPLLVTKAIRPTRIAQWLLIPWTLDRMELWTLI

SEQ ID NO: 2216 - protein, 44 aa, Homo sapiens
RRPKMENGSTNHQEPVNFITFLEWKQEDLVGDVLGSQVIRSLTT

SEQ ID NO: 2217 - protein, 15 aa, Homo sapiens
LYCKKRRKVDGSLRN

SEQ ID NO: 2218 - protein, 127 aa, Homo sapiens
RTARSPGSTAAWRPAIWKLRAENPSPESNCHRISWRPCLSQPPRGARPAAGGTRRGRSCGHVSSAAPPRCPARTPGWPPSTSGTASAPGAWSTPAGWCRPPTASPTAPPGTASPWCWASTSSTARRT

SEQ ID NO: 2219 - protein, 123 aa, Homo sapiens
AATPAPCGRPWSPWSPTTSAAALRSTAPTSAPTCSVPATSTASPTPARGTQGGPWPARRTAWLTSTASSAGVTAAGGSTSRGSTPAWPTMWTGSTTGYGLPGGLWLPPDPPAGHPGSHHSLPC

SEQ ID NO: 2220 - protein, 120 aa, Homo sapiens
RTARSPGSTAAWRPANPSPESNCHRISWRPCLSQPPRGARPAAGGTRRGRSCGHVSSAAPPRCPARTPGWPPSTSGTASAPGAWSTPAGWCRPPTASPTAPPGTASPWCWASTSSTARRT

SEQ ID NO: 2221 - protein, 182 aa, Homo sapiens
PLRPQQQVLQRQRDPKVGGSRPRPGQFPRAVAPRPKHSPRTGGPAGSPSATGAACCMPALRRAVHTGSGVPQLTTTTGTGPGATVWRPPRLQGAQLPWIPVPPAPASMEAPAPIPRTPSPITAAAPGPSPARTAAQRNALMRPATSTWRGATAGPACARATWNSASASGAGPGAKAPDIQLV

SEQ ID NO: 2222 - protein, 159 aa, Homo sapiens
ASLPGAPGLRQEAQEEDVPAATYHRRLLLAARLAPLAGRHLHRGQLLRREPGPHLLGGVGRPLLLPQPPQGQRLRGAGPALLQPHDGRDADLRHREVHPVHPVLGVQPQRPRPRPDPAEEERGPLCHTLAVRAAHLPARARQHLPRRTQVPDCGLGPLG

SEQ ID NO: 2223 - protein, 270 aa, Homo sapiens
VTFSPACGRARTSRAPAVGSASAGTVCATAKAATRVSSASMTTSSVPALPGSSAMTEDAAPWASVCVSLVGQAQAVTVPSAMPPASTAMGASVMDVATVSVAAATATSSRSTRTPSARSTTRRSTRASARTYAPACSARRGAPARRRGARVRNATSRSRWWTSLREPRRWWCAAPSGTRMTTAPTATPWKVTAPLGPTALSWCTRRRTALRAPSGGSSPCSSSSCRSWPCYCCYAGSTVPAARPAWHFSRAATEVTWWALRKTTTCCGRT

SEQ ID NO: 2224 - protein, 99 aa, Homo sapiens
SSWSCKKLTPSCGAARSAVSTSSSATLSLGPTWASPTPPPSSSGTQMNWTGASRVRCCHHSHPLTATWAPRRTPMLRPLGPGRSISTGCPLLASQWGTG

SEQ ID NO: 2225 - protein, 93 aa, Homo sapiens
AATMNGATWTPRAPTPSTGHRTTRRCPPWCACSPSTTSSPSLLSPTTPIATTRSFTPISLSPHWGCCRRTRPTSWSCWRRPSIGSAPTWTSGP

SEQ ID NO: 2226 - protein, 16 aa, Homo sapiens
PPLLLQERHQPDRRCG

SEQ ID NO: 2227 - protein, 139 aa, Homo sapiens
SSWRRGHGHGRRRLPGWAWASRRPSSTGRSASGGALWLLSPSRKRRRGSSPPGRHWLCPQTRRSPCPPMPTRRSLAPTAAGSRCQGASVPQRRAWPELSLWCFCPHTWGRVGGAEVFLSLYTYIDAHIIYMYLWSKPQN

SEQ ID NO: 2228 - protein, 125 aa, Homo sapiens
PRLSLCPETLARWARHLCPRCLRMEDPVTFGDSTQEAQACPPRGLTVWVAAGVCSRLGRVLPSSLTSSVPLGPAAWPLPTSQMASGGCSPVRGSRQLPTLEDGCEANRGAPASLGTAPRPWLGPA

SEQ ID NO: 2229 - protein, 195 aa, Homo sapiens
ALPRKKTSACRPPLPLRPSHSSPLPSRSLLIPPPRLLAPFLRPCHLLPLSDLPSLTSGLPHGLWFLLKSTHLLLLIALPSLQQLLELSSLKPGALTPLQQRPGAPGPCLAQAPIPWLNWSSCWAAPVITSSQYSSGLRPCLPSPRSRWRHPLPPRPRPHPLYFRGRLPRHPRSPTPTRRPRPPCSSTSTTSAASS

SEQ ID NO: 2230 - protein, 87 aa, Homo sapiens
PRKTIAAWARFPRMSSCMFSPCTRWPTRMSLVARRTRMQRWAAEPSRCSPPSPARSDACPSLPSPAASGSWKPERQQPRRRRFRRRS

SEQ ID NO: 2231 - protein, 114 aa, Homo sapiens
SLDGGSSQPLQSGKTPRTQEAGMTTRTTTLPTGEEDDLMKRHLPLGMRIPARIRGGEVDASPIKDGLLERMVGGRKSIRQKTAIGKVLQVNLCLGGVKEGRMKSGLGVMVAMQA

SEQ ID NO: 2232 - protein, 33 aa, Homo sapiens
NVGSPLHRPACSLGVGQGLLPAQHLEQTQTTHK

SEQ ID NO: 2233 - protein, 199 aa, Homo sapiens
SWFVWKQHSTIERSAHTRAATKFFSQSPGASASPVYFPPGFCLNAQAVSQQWPESRSFQCGAPVISSTNCHAEPASTNSPVSVGMSASLAAAATAAVVTEPEKDFSSCTPTARAAAGSNGECTAAAAAAAAEAARHEALALSSCWAQAASGQHGTQRIECGAPRPSNQRANTWIWFWLQLWRHGLWHGWWEGGWNRVSL

SEQ ID NO: 2234 - protein, 87 aa, Homo sapiens
KLENGVVQTNQILALEHGTIKRATPSLKTKAMPRLPVGEDLPAPQEVKLEVKALEATTKQEVVTVITLAVGRTGPHILIVRLSCRLF

SEQ ID NO: 2235 - protein, 133 aa, Homo sapiens
EEKKSWVIHPLIVTSELVLGTNHMSIMNVERSQIRINNVGKPSVTTTHFKHMRGFTLERNHMIVKNVGSPSVLWETFKDTWQCSVEMDLINVSCVGKRFFGPVYYICMKERTLERNHMNVSSVLKPFLFTVPI

SEQ ID NO: 2236 - protein, 125 aa, Homo sapiens
ERNPMNVHNVVKPSLIPVFFKDMKKLILERTRMNVRNVGKHLLLSVPCIDIKRLTGKKLTLERTHMNVRNVGKHLLLSVPCIDIKRLTSILSKCMECGKAFINFISFQILVRNTLEIDPVNVSTW

SEQ ID NO: 2237 - protein, 27 aa, Homo sapiens
DMKEHILGRNRMNVNSVLKPFLFTVPI

SEQ ID NO: 2238 - protein, 271 aa, Homo sapiens
GPKLLPVQGPHLPTERLLGTLPPWRHLGSQRPAHNPGVSCQSRSRRPPGSRAPCSGSRRRQRRSPGMPRPPRAGCGSVRAPTRGTCRAPTARSSRMRPAAPCTAFRSTAPSPRGRAARARGQGSQGPSPGREKPAWSWRRSGWRSASPSSSPTTRRWWTMPSWTTCGPGRPGCPNRAASTCPRPTPTRTPSTLTSARWSQAVGGPRAPCAPPGRPQTSLGPSSSTPSPLSSPPPWNVSPSPGATRCPSSRAPGRGWSPGSPGTPGPGRRSL

SEQ ID NO: 2239 - protein, 32 aa, Homo sapiens
GGQHPGGPQLFQATGWEKRGTVGGGQGGQDGH

SEQ ID NO: 2240 - protein, 101 aa, Homo sapiens
RSTSGPTRVRGPSRVPPAASPLRPRAISTSTGGRRRTSTTPGCPQSPRAPGAASWRKGTRPESPPDQRAGARAGARGCTKAPRRDPFLRVPTCPYLPRTWM

SEQ ID NO: 2241 - protein, 68 aa, Homo sapiens
KPVPMEARKPGRWEWAVGQNWAFLCRKRQQGAQAQSPPKTGGPLSMRTYPQGQRQSLGEIHQPWRPPW

SEQ ID NO: 2242 - protein, 56 aa, Homo sapiens
WIYSTFSETGTWSSSVTMNKTVVHLKKGNGSGGIKKSSKKTISFLQALIFLGSHTR

SEQ ID NO: 2243 - protein, 143 aa, Homo sapiens
SISCQQLVRQCLKGQLGKNSPKKLRRTPALTSLPGPNQILPAALPKKKKVWSFMTHQEAATKPLPTNQPLGKNQDLTSLWLPRRRSTEGLARLCQSLGNSLKQIHLHLTPTQIRKRPCKSKSCLRALFLEVILPNPRKSVVPA

SEQ ID NO: 2244 - protein, 42 aa, Homo sapiens
NLQLNLRTALGICHLEHSWMENPVQPVQRLNCQSSPSSKQVK

SEQ ID NO: 2245 - protein, 23 aa, Homo sapiens
LNIQTKVMHLPTESRTRLETMMK

SEQ ID NO: 2246 - protein, 94 aa, Homo sapiens
LDKSHLPNLRELKANSVLLSKGYRRETLQKRHPLPPSLSPILLLPLLLSLLLPLSPPLSQLLPPPRPPPQLLPLPFPPSPLPSLLASWIAVTWR

SEQ ID NO: 2247 - protein, 76 aa, Homo sapiens
WIYSTFSETGTWSSSVTMNKTVVHLKKGNGSGGIKKSSKKTISFLQALIFLGSHTRQTKVMHLPTESRTRLETMMK

SEQ ID NO: 2248 - protein, 71 aa, Homo sapiens
MRETLQKRHPLPPSLSPILLLPLLLSLLLPLSPPLSQLLPPPRPPPQLLPLPFPPSPLPSLLASWIAVTWR

SEQ ID NO: 2249 - protein, 110 aa, Homo sapiens
RDKRVKEASRGYKVSLGFLECKDLRGHRDHQDKRVILENQDYLEQKGQEDLREHLATLETQDFPEFLAKTARQAPQVFQDAMAQRGREGRSGLLACLVSLEIPDHQAYQG

SEQ ID NO: 2250 - protein, 219 aa, Homo sapiens
KESVAPLEELDSQAVVVTPAPLGLQDMVLLVPLVTKDKQAFLEALDPQACQVQRVNQEKLFLYQAPLEQKDCRGPQASQVPKETEAFPEPQEGQACQERRALWASQALDFQGPPAPKVLTAYLETWGHRGLQVARDLMAYLGTQVCRARRESLELVYRDSKVCQVFPAFLAHPGRRGALGYQAFLENMERSDPLGFRGSEVNRDLLDCQAPWGLQEFQE

SEQ ID NO: 2251 - protein, 90 aa, Homo sapiens
VFKDQKVTRVTKGSVGLQEYQDKLKFKKKETSPPREKRAKKVNLDFRGCQGSERKVNPENQDPEANPEKMVTKGKKGVPVFLVNPGTQDS

SEQ ID NO: 2252 - protein, 16 aa, Homo sapiens
HRPPWASRIWSCWSHW

SEQ ID NO: 2253 - protein, 77 aa, Homo sapiens
KGFRDCQARKASKVLQDWWVYLDLQVFLGLTVPLARKERWDLPGLLVQEDFQVHQAPMGCQDPWGPQAPHLLITASL

SEQ ID NO: 2254 - protein, 54 aa, Homo sapiens
DQMRILMVFHRNWWYVQLLLDFLLFSFFCGEVLDRLGVGFMWEESKNLVQRFLD

SEQ ID NO: 2255 - protein, 36 aa, Homo sapiens
EEDLLSPHLLQEPCLELLEVIFHQGISQVHHMLHLQ

SEQ ID NO: 2256 - protein, 83 aa, Homo sapiens
KKILMHSMFQIQHLAESIPHVVPHHWVGLHLKRELFPLLKLCWRIHSDSHLCFQGEEEEAQAAQGIPWTIRLPMKEENQAMTG

SEQ ID NO: 2257 - protein, 27 aa, Homo sapiens
DWLAHLPTRGVGRGECSGRPATPDSDL

SEQ ID NO: 2258 - protein, 20 aa, Homo sapiens
GARQEAAPPGCTATGRASGW

SEQ ID NO: 2259 - protein, 181 aa, Homo sapiens
QRFLLAPQTLDQGGHNCSRRELSLLLLLLLLLFFLCSVGCGTPRGWAAGWTATERQRAELWASHPTRLLRGLPGHGGLPGPGRCQALLLHLPCRAPILCFLSRDAGQWGWGGLPGGSCGHLCGSCRARGGWSRGPGRRQPPQAALQRGGQVDGSCRGLPLPAWIPTSTRRQGLPSLPTGAL

SEQ ID NO: 2260 - protein, 78 aa, Homo sapiens
TSKSGALGLSPNAASTWPSRTRGPAWPWSLSGSSPTPALPCSDPLLPFQRRRPVGLGGPPWWQLWAPVWLMQSQRRME

SEQ ID NO: 2261 - protein, 51 aa, Homo sapiens
DALRRSQRQSAGSALKRTRRAPTMAQPKALPSSGRTPQSLQGTQGNPRRRP

SEQ ID NO: 2262 - protein, 44 aa, Homo sapiens
CFGFSLAGLHLCARIWRNRFHLLARGKHPITSSSICASLTAGTT

SEQ ID NO: 2263 - protein, 27 aa, Homo sapiens
DTRKKRHLLLRRMCVAPITQVITSSNL

SEQ ID NO: 2264 - protein, 100 aa, Homo sapiens
AKHISLYSPKMGSSSRFCYCLRNCHSQTSQGFEGVSFTNGSTNSIYDWRTGHEDAGSNTLGSVLVSHWLDFICVPEFGETDFTYWPGENIRSPHLQYVPH

SEQ ID NO: 2265 - protein, 14 aa, Homo sapiens
KNSMPNWKYIKERR

SEQ ID NO: 2266 - protein, 165 aa, Homo sapiens
CCRAISRGSRTCRTTWIGTRRWCGAFWRASPASPGRPSPSAPIRCPHRPHRSSSRPRARRAASCSKTCPPPHPTWPTPLWRPSGSTASGASGGPTYTAAAPIRGPGAWATAGGARTGSAGTRATSSGLRLIWSARTGVTSPGGWLLFPLPSTGCSLTWSRNSGVS

SEQ ID NO: 2267 - protein, 55 aa, Homo sapiens
PVEHPQGPPVPRLNVAGQTAELTKERGSVGGLAVVVWLLLHTTPGRKPWTWTKMS

SEQ ID NO: 2268 - protein, 36 aa, Homo sapiens
PRRAGCTSPNPTVSSATCRRTKNASYAIPKILIMRP

SEQ ID NO: 2269 - protein, 25 aa, Homo sapiens
LPKKLKSQLMPEGKPKCYKMKQKLF

SEQ ID NO: 2270 - protein, 175 aa, Homo sapiens
TARTTPWVITVKGAWLVTMATPSLGQEITAALALAQMVPTVDASLPGAATKILLLYSLPVFVILDTLVPDVTTVPQDTLAIHQKLGGRVSLASVTTTLTRQTQKPVTRRLGGVSSACTTRKGNTVSSAGLDTMVMPSSRTVESVSVITWAPCKSTVTALTASATKPLVSACVFLM

SEQ ID NO: 2271 - protein, 59 aa, Homo sapiens
GSAIMSPGWRTASSACSKRPQPCTVCATCLSSHGWCPNATRNCCCRRGGPQRPLQICTC

SEQ ID NO: 2272 - protein, 245 aa, Homo sapiens
FCSIFCCMPPPQTQLPKVWDPVFFGAASPPSCTWADWLCGAWACAATCSQPSSSRQHRSALMTFLLASWCVPKVSCQGVRRPWNSFTSLSSASLPRSTWHSVLMCHQLCSDTSSIVAGQATHQWPGSCPRCASRPRRERTAAWQLCCRRPSRTTFRSQQPSWQGCCPGSTGACWLSARHLRRPCSGARPVPAGVWPAASASTSTPSRQLHRVRPRACMPCPGSSGSSGACTRCRRSGWLGRLHVA

SEQ ID NO: 2273 - protein, 115 aa, Homo sapiens
ARGGGPPHPPAPRDLSPARFVPPACLLMDGVQMPPGTVAAGGGVPKDHYRYVPADSAAFSAACHPPRLSFPRSGTQSSSGPPPHPPAPGQTGSVGPGHVLLRVLSPAAPGSTGQP

SEQ ID NO: 2274 - protein, 59 aa, Homo sapiens
LLPLRPLPSFLPYLFQPPLPVHLHTHAPLHSQMPPHSPHFQFCPQQCPPLPLPFLPWSP

SEQ ID NO: 2275 - protein, 50 aa, Homo sapiens
KAKNLGHLLVIRKKDLRLRIMYTCGRCITQIWDGCALMPLIQRRETGCDM

SEQ ID NO: 2276 - protein, 28 aa, Homo sapiens
LMLRGKNLKLWPRIILLSFPAKHHGACT

SEQ ID NO: 2277 - protein, 92 aa, Homo sapiens
INTPPSAVPKNPFLLPKKKFLIHLRKVDTHHLQVVTKTVTATTADGQRMRRLKCKACRLRWARPEPAAQAPPKSHFPPHPSGPSRTSSLQLR

SEQ ID NO: 2278 - protein, 64 aa, Homo sapiens
NAKHADSVGQDQSPQLRPHPSPTSLLILQVQAERQVCSFGEIQKTKLLLFKELQPDKNGQNNSC

SEQ ID NO: 2279 - protein, 58 aa, Homo sapiens
RPQEARGEEQKCSCCEKREGAKKPGSRCPGSEGKHAEPGWRSHRVLPRHHLSSFPIQS

SEQ ID NO: 2280 - protein, 36 aa, Homo sapiens
RLCTRCWKTDALKTIPPPTKRSASWASPTGPLTLPR

SEQ ID NO: 2281 - protein, 34 aa, Homo sapiens
SAVCRRSHSGVSEHSWWGSKHAAECVYSRHPANG

SEQ ID NO: 2282 - protein, 101 aa, Homo sapiens
ATRWHAKRRSFSTICARSSTEKTTSSSWSVMGTGSTATSPLPSASTRSSSPPRHPSRPSKPTWQVTTGSRSRPCRRQPCSMTGCVLGSWPRSEQVLESLCT

SEQ ID NO: 2283 - protein, 85 aa, Homo sapiens
LSLKRKTSCTNTFPSPSLTGWRSTIWISTRCWRNGRRASWRSSVRGWRSSSMSKHIISRRGTNTAPLTSSSATTRTPARLWCCRS

SEQ ID NO: 2284 - protein, 102 aa, Homo sapiens
PLWLLLPDLRQHGAAPPHCELVHPPILDARFWCTWSPSSHPPPGHCAPLREAGAAALRPQPEDTSRVQGREGGQEANHQEAPQCLHAVHEGDESQGHCRVHT

SEQ ID NO: 2285 - protein, 97 aa, Homo sapiens
TALPCPHCSPWRPLPQVHPPILDARFWCTWSPSSHPPPGHCAPLREAGAAALRPQPEDTSRVQGREGGQEANHQEAPQCLHAVHEGDESQGHCRVHT

SEQ ID NO: 2286 - protein, 90 aa, Homo sapiens
RPRSAPAACTKRPSTPPSICSCITHPPREQGSTPSRSPRCTRPISPPTVSPNSLSTNISTAHIPPLHLRTSARSKFTGLCRPLTSLASTP

SEQ ID NO: 2287 - protein, 82 aa, Homo sapiens
CTKRPSTPPSICSCITHPPREQGSTPSRSPRCTRPISPPTVSPNSLSTNISTAHIPPLHLRTSARSKFTGLCRPLTSLASTP

SEQ ID NO: 2288 - protein, 161 aa, Homo sapiens
RRGAGRQEPRQRRRSRARPGRAQVVARERVRGRGRRRRDPGGPGGRRRGPRRGRGSRAGTRCAETLPGQTSRAPGGRPEGPGVHQRHVQRDRLLRLQSAHALPTPLGSRAAPPAAAPAAQGQSAPPRCPPTLSLRTFQQPTSHPCTCGHQPEASSQASADP

SEQ ID NO: 2289 - protein, 31 aa, Homo sapiens
KFIVYCCCQRDCMELPFKKTKRATTEDLQEA

SEQ ID NO: 2290 - protein, 22 aa, Homo sapiens
MESLTFFCVTHPQTKMSISIMS

SEQ ID NO: 2291 - protein, 20 aa, Homo sapiens
RATITKKIRLLKCDRTCWSS

SEQ ID NO: 2292 - protein, 113 aa, Homo sapiens
VVSRPRRRCRSWCGGWGLCWRRSGHHCFRPLKNASRSGWPVSAPRSRSTGACWMAQVWWAMPRKYLRKQTSLALCKPPSSCTTGLPEPLKPSRHSGQLPAPPSAIASSTWDVR

SEQ ID NO: 2293 - protein, 110 aa, Homo sapiens
HTSWETRTRYRPRSVSWRRSGHHCFRPLKNASRSGWPVSAPRSRSTGACWMAQVWWAMPRKYLRKQTSLALCKPPSSCTTGLPEPLKPSRHSGQLPAPPSAIASSTWDVR

SEQ ID NO: 2294 - protein, 64 aa, Homo sapiens
QSLTSCECLRPPSLTPSAPLPMIRSSCAGGCPPIHHLPGTIPLSSGARMCLLSQAPPAGSGGRR

SEQ ID NO: 2295 - protein, 51 aa, Homo sapiens
SLTNCCITADRTTTRRQASSPVRSLVSTTLHTTFTARGATCGLLYSRTTSP

SEQ ID NO: 2296 - protein, 120 aa, Homo sapiens
RRQGLRDARCARCKGASRDARPSRPCWTARSGQTRSDRLPWAPGPPGKARGSRRTWATRPYWGTGGSRTSWDTRNWKARPGWDPRPARISRWQRGARTARATRTPRPSRDWETRLPRTQR

SEQ ID NO: 2297 - protein, 103 aa, Homo sapiens
QASLGPRAPWESQGLQENLGHKALLGYRGFKDLLGYPELESQARMGSQASQDFQVAKGSKDCQGYQDPQAFQGLGNQASQDPKVTGAWEVFLGLLDQEGRKDQ

SEQ ID NO: 2298 - protein, 73 aa, Homo sapiens
CTRTTSTKRASWTRHLGVQCCCSGPETGCSSRCPQNRLQDCMPGSMSTPPFQDIYCIPCKNKKTKNKEKKEIL

SEQ ID NO: 2299 - protein, 73 aa, Homo sapiens
GPRGKLGKKVYQDSLVFQGFSDLRESQESQGIRVYRAPQVSQGLGALVAPLDHLGFQAPKGSRASQGPLGSLV

SEQ ID NO: 2300 - protein, 48 aa, Homo sapiens
GRRGMWAPTRKRWTSSWVPSSCRPPHAEKRSLGRWSLSDPTVHRGADP

SEQ ID NO: 2301 - protein, 128 aa, Homo sapiens
MEMAGVRAEWRSYTEAPGAPCVMTAGTPMMPTWSVGSWVVAGPCQLQEMPGLARAQDPLPWMMCAAQDTNPTCGAAPTMAGSPITVAMVKMLVLSAQLPSLSQHSGQKVGLSGYHHLYPQKDLNPVWP

SEQ ID NO: 2302 - protein, 125 aa, Homo sapiens
MEATGVEAEWRSYTEAPGAPCVMTTGTPMMPMWSAGSWAVAGPCQPQEMPSLARAQDPLSWMMCAAQDMSPTCGAAPTMAGSPTTVAIVKTLVSSAQLPSPGRHPAQILGRPHMHQQQDLNPVWP

SEQ ID NO: 2303 - protein, 125 aa, Homo sapiens
MEVTGVRAEWRSYTEAPGAPCVMTTGTPMMPMWFAGSWAVAGPCQPQEMPGLARVQDPLSWMMCAAQDMSPICGAAPTMAGSPTTVAIMKTLVSSAQLPSPSRHPAQTLGQPHMHQQQDLNPVWP

SEQ ID NO: 2304 - protein, 125 aa, Homo sapiens
MEVTGVRAEWRSYTEAPGAPCVMTTGTPMMPMWFAGSWAVAGPRQPQEMPGLARVQDPLSWMMCAAQDMSPICGAAPTMAGSPTTVAIMKTLVSSAQLPSPSRHPAQTLGQPHMHQQQDLNPVWP

SEQ ID NO: 2305 - protein, 125 aa, Homo sapiens
MEVTGVRAEWRSYTEAPGAPCVMTTGTPMMPMWFAGSWAVAGPRQPQEMPGLARVQDPLSWMMCAAQDMSPICGAAPTMAGSPTTVAIMKTLVSSAQLPSPSRHPAQTLGQPLVHQQQDLNPLWP

SEQ ID NO: 2306 - protein, 125 aa, Homo sapiens
MEVTGVRAEWRSYTKAPGAPCAMTAGTPMMPMSSAGNWAVAGPCQPQEMPGLVRAQDPLSWMMCAAQDTSLTCGAAPTMAGSPTTVAIVKTLVSSAQLPSPGQHLVQTLGQPHMHQQQDLNPVWP

SEQ ID NO: 2307 - protein, 119 aa, Homo sapiens
MEVTGVRAEWRSYTEALGAPCVMTAGTPMMPMWSAGSWAVAGPRQPQEMPGLVRAQDPLSWMMCAAQDMSPTCGAAPTMAGSPTTVAIMKMLVSSAQLPSPGRRPGQTRCRPSRYLHRQ

SEQ ID NO: 2308 - protein, 119 aa, Homo sapiens
MEVTGVRAEWRSYTEAPGAPCVMIAGTPVTPMWSAGSWAVAGPRQPQEMPGLARVQDPLSWMTCAAQAMSPTCGAAPTMAGSPITVSTVKTLVSSAQLPTPGRRPVQTHCRPSPCLHRQ

SEQ ID NO: 2309 - protein, 119 aa, Homo sapiens
MEVTGVRAEWRSYTEAPGAPCVMIAGTPVTPMWSAGSWAVAGPRQPQEMPGLARVQDPLSWMTCAAQAMSPTCGAAPTMAGSPITVSTVKTLVSSAQLPTPGRRPVQTRCRPSPYLHRQ

SEQ ID NO: 2310 - protein, 115 aa, Homo sapiens
RSYTEAPGAPCVMTAGIPMMPMWSAGSWAVAGPRRPQEMPGLARAQDPLFWMMCAAQDTSPTCGAAPTMAGSPTTVAIMKMLVSSAQFPSPGRHPVQILGRPHMHQQQDLNPVWP

SEQ ID NO: 2311 - protein, 110 aa, Homo sapiens
MEVTGVEAEWRSYTKAPGAPCVMTTGTPMMPTWSAGSWAVAGPCQPQEMPSLARAQDPLSWMMCAAQDTSLTCGAAPTMAGSPTTVAIMKMLVSSAQLLSPSQRPGQILG

SEQ ID NO: 2312 - protein, 109 aa, Homo sapiens
MEVTGVRAEWRSYTEAPGAPCVMIAGTPVTPMWSAGSWAVAGPRQPQEMPGLARVQDPLSWMTCAAQAMSPTCGAAPTMAGSPITVSTVKTLVSSAQTRCRPSPYLHRQ

SEQ ID NO: 2313 - protein, 104 aa, Homo sapiens
MEVTGVRAEWRSYTEAPGAPCVMTAGTPMMPMWSAGSWAVAGPCWPQEMPGLVRAQDPLSWMTCAAQGMSPTCGAAPTMAGSPITVAIVKTLVSSAQDLNPVWP

SEQ ID NO: 2314 - protein, 100 aa, Homo sapiens
MEVTGVEAEWRSCIEAPGEPCVMTAGTPMMPMWSAGSWAVAGPCRPQEMPGLARAQDPLSWMMCAAQGMSPTCGAAPTKAGSPTTVAITKTLVSSAQPPK

SEQ ID NO: 2315 - protein, 60 aa, Homo sapiens
RILQKLLPSSVRDSRTLTKASMSSMLQAATTSMQGSHSQEFMMLCLILKAKWTLPRPGEK

SEQ ID NO: 2316 - protein, 48 aa, Homo sapiens
GYQTGLFIGMSSMLQAATTSMQGSHSQEFMMLCLILKAKWTLPRPGEK

SEQ ID NO: 2317 - protein, 37 aa, Homo sapiens
LPDMGKFSEEIRLKMPSWQGPKESFSTPTLLTTLLLG

SEQ ID NO: 2318 - protein, 30 aa, Homo sapiens
KALMKALKANLFMKVGLKKVLPQSSVACPG

SEQ ID NO: 2319 - protein, 45 aa, Homo sapiens
KLTSGELKKWRMNYRRQSGHLKTRSLPMRRKLMKTGSKLVLQKEL

SEQ ID NO: 2320 - protein, 33 aa, Homo sapiens
TAAQEALPLPGYSMKARLIWLQKGPLLSQESLS

SEQ ID NO: 2321 - protein, 23 aa, Homo sapiens
KKLYRIWKKTLNYLRKGNLNLNQ

SEQ ID NO: 2322 - protein, 17 aa, Homo sapiens
QLIWLQKGPLLSQESLS

SEQ ID NO: 2323 - protein, 17 aa, Homo sapiens
WKKTLNYLRKGNLNLNQ

SEQ ID NO: 2324 - protein, 56 aa, Homo sapiens
WTRGCGSPASSPTTAWAASAPVCLRSHLSQSSRKGCWTDVLPQDPIPRWWRVAGAA

SEQ ID NO: 2325 - protein, 54 aa, Homo sapiens
NKRLENRVTLKSSSLPQALSPMYPHTAPAWRRTAPACLGRVWMDICRLWGHVQG

SEQ ID NO: 2326 - protein, 126 aa, Homo sapiens
AMGMAAQGKRQAVPAVLAPRAPLNLERSYHHCLGDLGQGTPGSGQAGALQSRTLGQEEKRRLARPPSPPLQGEESLRGLGLGGWQQVGLGVVQTDWSQRWYAWWWKVWRGSSGASQGGMLGRSHPC

SEQ ID NO: 2327 - protein, 73 aa, Homo sapiens
NKRLENRVTLKSSSLPQALSPMYPHTAPAWRRTAPACLGRVWMDICRSSRKGCWTDVLPQDPIPRWWRVAGAA

SEQ ID NO: 2328 - protein, 60 aa, Homo sapiens
NKPKAFLQAAKARQQLPRRSRTHPGGNPLQCPRARMLPPKNRRKSLEGGENPKCPKLSSL

SEQ ID NO: 2329 - protein, 39 aa, Homo sapiens
RPTSTAATCTSPPPETSPRVPSCACGMRPSMPRRWTSPC

SEQ ID NO: 2330 - protein, 37 aa, Homo sapiens
PLIPSAALPCCTTAKMTSRSTPSRKPRTHSLWPISST

SEQ ID NO: 2331 - protein, 74 aa, Homo sapiens
ADSGAGGFGRREARESCQAKSQEKAEARRGGGCSGARGRHLQRILRERDGVHRQCRRRDQFRSTEHSAGSGDPG

SEQ ID NO: 2332 - protein, 63 aa, Homo sapiens
TSVGPLRTSQKPSSRQPKRGSSSREGAGHTPGGTPCSARERECCHQRTEEKASKGEKTQSVQS

SEQ ID NO: 2333 - protein, 154 aa, Homo sapiens
CPAAAPRLPVLRSFRSGSQPGVRIRSRSAHSKGSRAPPRSSRHADCSLLHSPAAGTVGDRSQNPAGFPGAAPGSPCAPPARRGLRRPGPRPRGPRRRAASSPRPQGMSLSPALGYSPCGSHGGVPGPPTPRLEKLSPGPRLGTRGSVSSSWKHL

SEQ ID NO: 2334 - protein, 97 aa, Homo sapiens
SPAWAQLPQSHPLPTASGLKNIPGIRGALTTRPSESPPAWNLAISNLLPSASWIKLETAGTPGMSLPILPCLCSFLDLTYYFFCFCFHPSCLSCPEG

SEQ ID NO: 2335 - protein, 66 aa, Homo sapiens
GSSSSSSWSSCPSFASVAWLSASVATAESRSQTAQWIAGGPWNCPPSSPQRGSEYPFLRPHPPTVR

SEQ ID NO: 2336 - protein, 50 aa, Homo sapiens
VPAPICLGEAHGPQQTSAAAPPASPSGPRGVPGLCTDGSSRLRDAPSADN

SEQ ID NO: 2337 - protein, 24 aa, Homo sapiens
RGTLSPGTCAGELCLKGLPANLNV

SEQ ID NO: 2338 - protein, 70 aa, Homo sapiens
PLPMQLVTCHHTGLQARLRSMSTGPHLPRRGTWPSTDLSSRPPRLPLRPQRGPRPLHRWLQQTTGCSQRR

SEQ ID NO: 2339 - protein, 61 aa, Homo sapiens
KRCRSSGSRRPSGSQWGMTWPRSCPGALPWSTATLTTTQSSTRTTGPTEQRPAERPRVGAC

SEQ ID NO: 2340 - protein, 43 aa, Homo sapiens
HLGQRQQHYQRSLEWEQWCLHPLAPPPPGQPQVFGGCFWFSPN

SEQ ID NO: 2341 - protein, 101 aa, Homo sapiens
RPCPAALLYRVLPGPRPTSLLPVRPATHGRRVVTSRTAAAALPAVTGVGAVVSPPPRPPTPRPAPSIWGMLLVLPKLIMALRPILTLSCWTNQLHEKERTL

SEQ ID NO: 2342 - protein, 170 aa, Homo sapiens
SVQAGGGFLLHRGAAEGGICCCCCCCCRRHPSPWDSHLRASSHPQHDWPASVCSSTTSAQSPVLRPRTSWPGVLPALRGSQQVSSWVLLAHSGRSCIPGSAILPDPSLTTHLHQCQLGCCPLRRLLSLSGPEPVAKLQRAPAASTCDEISSDRHFSTPGPEWCQESPRGG

SEQ ID NO: 2343 - protein, 40 aa, Homo sapiens
SPSQSSSERSRETPACPSRASRASANTRRGRTAWSPCSGT

SEQ ID NO: 2344 - protein, 247 aa, Homo sapiens
SYCDPCPGRLGHAEQAVPHGHRDQGVGHCVLRPPAPVHGSPSEVLHRAAQKDLERRRHAHPGPAVLLQIRAGGGQRGAHVPAPEEHVCGPAAGGGHPARQDARVRRGQARGRHGAGDGHAVRADEERAEDHATDPVQPLPEDQRQAGRREQHPAAPGQAAGVPAARHLSGSRRHSPPRRGWEEALHCRRGGQHGRPPQSLLRHRARAAAPAGDHTRPGRHGPRAPHPVLQVHALQAHPHHLLPRRCL

SEQ ID NO: 2345 - protein, 80 aa, Homo sapiens
DSGHTGKIRKKRIMKGFRTKWKPVTNLTKEHLIWLITLFLKCLLMTRSNTFQLSFDFILEKLAKEWKNILVMSCFQFSDE

SEQ ID NO: 2346 - protein, 69 aa, Homo sapiens
TMMIQIFWIPKSSIVLSLSCMVMPPVTIPTIKIKVAVFLKNVYLQMKVLLRVLKKSYMCWRRSSILNKK

SEQ ID NO: 2347 - protein, 134 aa, Homo sapiens
EKLDWMVWMVKMETKDCLVLLERKGILEEGVIKDLEERKEKEEMLGFEGTRVTQDKTARREDPKEKPVTSAPWVSQGEMEYLEDLEKLGRMVALAEGDPPELRATRAVLASRALRESRGPEVHRAQLVLLVLQG

SEQ ID NO: 2348 - protein, 47 aa, Homo sapiens
DPPLLLLQNQWRPSLRSLGHRQPNQLPPSQPPLSPWLRCPVKSRCLR

SEQ ID NO: 2349 - protein, 43 aa, Homo sapiens
KPSGLLVGSWPISASPLISWWRTTSPGQGAAAWRKGFPRCWSS

SEQ ID NO: 2350 - protein, 115 aa, Homo sapiens
GKWLFSSATHPQEHPHSSERLCSSSQMRGSPPCSLQGRKTGSSSTLCRSITQQWGMRLSCLQGETSQTSWRMSSRVMFAWTSATSTHPVDLAVGGLPSGTGERQGAMWTSTWLSS

SEQ ID NO: 2351 - protein, 36 aa, Homo sapiens
TPSGGEASNGSEACSSKASSCKTPRCCCCKTSGDQA

SEQ ID NO: 2352 - protein, 33 aa, Homo sapiens
QRTAPNSTGRGLSPPVLIFMTSPSPQPMISPWF

SEQ ID NO: 2353 - protein, 58 aa, Homo sapiens
CQGSLTCLVMKLSALLTASVSMTTPGGARDASAPWAKVVRAAQKILLSSILSSLATPM

SEQ ID NO: 2354 - protein, 58 aa, Homo sapiens
RILIRHFKLLLNLGRRQRMAYCSTVGRTNTGGGISCPWLSSDAPCSSGLIVELGLPSS

SEQ ID NO: 2355 - protein, 149 aa, Homo sapiens
QAIYERARGLYLSLHPVHRLPHFPRGRCRGWEKHQHLWSQVTPAGLVQGTEPSILRIPGALRPCLMLYAEAQGPGVFPLTKKKVHTDEKLRTKTGIPGWPFLLTLHELTQQNSLCRKHRTLSIEYVAAARDHTSMQIPEPVCYSSVTVL

SEQ ID NO: 2356 - protein, 12 aa, Homo sapiens
EIFGGKQEDVYI

SEQ ID NO: 2357 - protein, 46 aa, Homo sapiens
IPEHPSTMDQEHSSVTFIPVVTDMVISQKGTKNTIMKLPICLSMTS

SEQ ID NO: 2358 - protein, 41 aa, Homo sapiens
SKKADTFFFPDELQIVICFPVLIQEIWKGDFKASITGTERM

SEQ ID NO: 2359 - protein, 40 aa, Homo sapiens
KAVDLLPLEKDHFHSSSTGLCHVPQGSHMPQLEEKEEKSH

SEQ ID NO: 2360 - protein, 68 aa, Homo sapiens
VQKSHPESFPGKIPPKCIYRTQINPMTLNKIRGLLKTENLAQQLPFLSFRNTEHHHLSPGQTKVVTRN

SEQ ID NO: 2361 - protein, 58 aa, Homo sapiens
WAGGCRSVRPTTTTTTTITTPSRLPTRLPGTWGCPTPTQVVVQAMAHRTSVRLTAPTR

SEQ ID NO: 2362 - protein, 143 aa, Homo sapiens
DYNFPVVRGQRQQLRRRRPLPSGQGGADRFAPPPPPPPPSPPPAGYLPDFREPGGVLLPLKLWSKLWLTELQCALQPLRVKSGSRRKWWVPPVRSRCLLWKSLISHGPASPPPPGLCWGRGGLASIHSPLIWTGAPEPGPGYV

SEQ ID NO: 2363 - protein, 107 aa, Homo sapiens
DYNFPVVRGQRQQLRRRRPLPSGQGGADRFAPPPPPPPPSPPPAGYLPDFREPGGVLLPLKLWSKLWLTELQCALQPLRVKSGSRPTKKPVAPPHRRHLLQRRLLTG

SEQ ID NO: 2364 - protein, 88 aa, Homo sapiens
VVGTPSALPLFTLEISHLPWSSITTTTRVMLGARWARLNTFTTHMDRSTRAWPWLRIITPCPLSTPATKKPVAPPHRRHLLQRRLLTG

SEQ ID NO: 2365 - protein, 48 aa, Homo sapiens
IVPFARLRMFLVWIIFLTCSFKEHFSLRNCIPAPVPVLSSTMLPVQYF

SEQ ID NO: 2366 - protein, 23 aa, Homo sapiens
EGKDFYPSAAIKKIAMTMDQYPF

SEQ ID NO: 2367 - protein, 38 aa, Homo sapiens
TQWVDLCQKNQFQMWISISLTSALAVAMLSFQYLCPCL

SEQ ID NO: 2368 - protein, 27 aa, Homo sapiens
KKCTVLIHVRLSGWIFAKKINSRCGSQ

SEQ ID NO: 2369 - protein, 51 aa, Homo sapiens
GSGKPRTGQAHGTKPEPPAQREVLPHQSAPDPGGLPAPSQAAADELDRRPG

SEQ ID NO: 2370 - protein, 13 aa, Homo sapiens
SGGAPCPQSSGGG

SEQ ID NO: 2371 - protein, 52 aa, Homo sapiens
TATTTTAWALPPSPSRGAPGPPSRLSPRLPMPQAHCRTLPQTRAPRPTPPSR

SEQ ID NO: 2372 - protein, 129 aa, Homo sapiens
LWGGCTSARPPLTTCVRRASPTRTRGTSCWWWPSRLMHRTRTTRWPPRSQSASLCGPPTQASSRATAMCCGSGHRCPTPSSTTAAWASTQTGRMRRWLCTGMSRSWARLCTPPTCAPRNTCRRWTPPSN

SEQ ID NO: 2373 - protein, 100 aa, Homo sapiens
QTTWRRALMSWSAGATSWPSCGGSTASSPPAARAPSAMQGASSVGRAASPTRRGPPRWPASHRPWFRTRPASASASCREPSLPWWWSWPSAWCPCPHCTC

SEQ ID NO: 2374 - protein, 76 aa, Homo sapiens
IPPQHPQCPDAEWNDQTGAWDRDSPASAPHSSPIATLASPGSALPGPWFLASQHCPCPDTALAPARCPLPRPPAGQ

SEQ ID NO: 2375 - protein, 50 aa, Homo sapiens
KRKMQIKQQVKDLLLWPDCKKMARRMLAVTSSQKECQAILMVRQEHHQAN

SEQ ID NO: 2376 - protein, 35 aa, Homo sapiens
VNRCHVLQDYRLLQAWWKKGLVLPPHLNLVLLVAS

SEQ ID NO: 2377 - protein, 12 aa, Homo sapiens
KKTPALREYTMM

SEQ ID NO: 2378 - protein, 146 aa, Homo sapiens
RQHPRHNSLTPFRPMPTAAQLQPSRAGGTGRPPRPLLVKSPRPSPTSFSTGLHSWPSPKPSLLPEPLAMGSQGYLSSATPRSQPAPPQLPKCLHGSGRRLPHRLHLLLPTCCCWDHRAGPGATRHRCHPRALASPGGSGSSPTPTA

SEQ ID NO: 2379 - protein, 140 aa, Homo sapiens
RCPPPRSTPRTPAAAPWPHAPSPATRWAAWTVSGVALAGPVGASQRTAAPEDPLPSPGDTPAPSSAWWGLGLGQRRPPARKQAHRSQPQRAESPAGRFLRRSPGEALTPSSLSPSMSPAPQAPLLEGGTCLFSASLGGPE

SEQ ID NO: 2380 - protein, 129 aa, Homo sapiens
SRLQLWPRPGRWRMGRCSLQLSPRLHPPLWAGPHRRLLGHLEPLPSVPSPWMRWTGLLIAREMPATPGRVVLRMGPRWPTSSMMSILTVHSCQWTPWMLIPVAQTTRPAPWPAGSRWKPHQFWSGQGFS

SEQ ID NO: 2381 - protein, 88 aa, Homo sapiens
SPPWTGSREKAASCPRRTSGRGVTHPPSPLPPSSQVMETQQSLRALPPPSSSRPASTTSMTPPGSGSWKRRPWGQAPAPVWRAFRAPR

SEQ ID NO: 2382 - protein, 62 aa, Homo sapiens
PRAWQGSPSCLWGEDTPAGVWGVAFHPSQPGPCGRPTPKLPSPMRRQPSWQWAASPSTATTS

SEQ ID NO: 2383 - protein, 34 aa, Homo sapiens
GHYFFLCGAWRKCYVLHGKRCYKEHNSLLASLIP

SEQ ID NO: 2384 - protein, 80 aa, Homo sapiens
ETDLTFTEIQVFSPINTTQFPKILLCLIVMKQEVLIIPRILPQEAAALGLLWLGAQASDPEEMARTGMQRPLVEVVVMLM

SEQ ID NO: 2385 - protein, 67 aa, Homo sapiens
CLCTTEWPLSAFPCLQFDCYKRFSLLKRQASFYQSLCQQHYFSFLWTCLFLWNIQIFMKLLWPIWNS

SEQ ID NO: 2386 - protein, 57 aa, Homo sapiens
RCSSTLGSCADTLSTSPRARQNVAIRSGWQWAAGCAQIPGSVLCGASGPCRCWRHMD

SEQ ID NO: 2387 - protein, 34 aa, Homo sapiens
FCVPPTLWTLCSSTPTCLRTCHLMPGPDSSGSRL

SEQ ID NO: 2388 - protein, 92 aa, Homo sapiens
SYTSGRSCAGFRRTWPLRCELCAAKGLFELAPWPRLPPTRKVPRGAAAWPGASRNWPSSAPRTPFSFTARGALATQRRSARVTGLHAPSYVR

SEQ ID NO: 2389 - protein, 69 aa, Homo sapiens
FCVPPTLWTLCSSTPTCLRTCHLMPGPDSSGSRSLWPPQRPSNSRKFGWQMRASTPAPCLTHCTFWTRL

SEQ ID NO: 2390 - protein, 56 aa, Homo sapiens
LVRPLQMQILQRSVGHCSGLTDRLYGANRAGEKKSAFATYKVKAAASAHPLQMEAY

SEQ ID NO: 2391 - protein, 55 aa, Homo sapiens
KGATPYKKLGSPGVLSLTKCQWCSTLTMSTPSRLLSRTAMNTSRRETHLHTYQPT

SEQ ID NO: 2392 - protein, 55 aa, Homo sapiens
RAPTSPTDRSRPPPEPLTKCQWCSTLTMSTPSRLLSRTAMNTSRRETHLHTYQPT

SEQ ID NO: 2393 - protein, 48 aa, Homo sapiens
ALLRNAERALALINRITGAALAGEKKSAFATYKVKAAASAHPLQMEAY

SEQ ID NO: 2394 - protein, 42 aa, Homo sapiens
IAGLTKCQWCSTLTMSTPSRLLSRTAMNTSRRETHLHTYQPT

SEQ ID NO: 2395 - protein, 40 aa, Homo sapiens
CLTKCQWCSTLTMSTPSRLLSRTAMNTSRRETHLHTYQPT

SEQ ID NO: 2396 - protein, 115 aa, Homo sapiens
KKARPSTRSLGGGGMHCPEKSKRNTTSWPGRSDSFICNCTPAGPRGITMERRRRGKGTSSRERPMMQILQRSVGHCSGLTDRLYGANRAGEKKSAFATYKVKAAASAHPLQMEAY

SEQ ID NO: 2397 - protein, 76 aa, Homo sapiens
KKARPSTRSLGGGGMHCPEKSKRNTTSWPGRSDSFICNCTPAGPRGITMERRRRGKGTSSRERPMEKKKVRSLHTR

SEQ ID NO: 2398 - protein, 71 aa, Homo sapiens
KKARPSTRSLGGGGMHCPEKSKRNTTSWPGRSDSFICNCTPAGPRGITMERRRRGKGTSSRERPMNTANVS

SEQ ID NO: 2399 - protein, 69 aa, Homo sapiens
NGHCLMSRQGASRVDKPSRMPGPHHRHTLSLTKCQWCSTLTMSTPSRLLSRTAMNTSRRETHLHTYQPT

SEQ ID NO: 2400 - protein, 66 aa, Homo sapiens
KKARPSTRSLGGGGMHCPEKSKRNTTSWPGRSDSFICNCTPAGPRGITMERRRRGKGTSSRERPMT

SEQ ID NO: 2401 - protein, 134 aa, Homo sapiens
VMSQGSWRQPASPWCQRTGRSPAPHRLCQLGRRWTTWGTAPRGPPGSSSPPHWPEASRGSSCGLPWCSPATRSICTCAPTPCHRSNVTSSACSSSCPSTPSTPGSASSSSETTSTTSTSTLCGTATKPLSFTAS

SEQ ID NO: 2402 - protein, 130 aa, Homo sapiens
PSSTTPPSASPSTPCSSSTSPPGSSCGPSSPSSSSSPSKPSSSCRSGKGCCWPSWSGAGSSRRWRPAAGTSWGLARWPPATRTSSSAWRCCSPPWPCVMPSPARCTQRRRRIHQPPRHPCRASPAASGRQ

SEQ ID NO: 2403 - protein, 32 aa, Homo sapiens
CSDWNQCTATKTSTCSNEMEKKNPAKTRIWHC

SEQ ID NO: 2404 - protein, 65 aa, Homo sapiens
DGEKKSSKDKNLALLREHLVGGRLFYMWISLEKQASNAFFSQEEQRCYLVILYLYLKRPHIFFLT

SEQ ID NO: 2405 - protein, 107 aa, Homo sapiens
WRTTRSWPATSWSGSGAPSPGWRTVCPKRLSRRCSRSWRTSATTGVCTSRPRCRRSASWRSTSTRCRPSCASATGPPSCPPRARWSRTSTMAGSTWSRLRRATRSGC

SEQ ID NO: 2406 - protein, 24 aa, Homo sapiens
GAAERAAPRPGRVLHRPHGAIPGP

SEQ ID NO: 2407 - protein, 61 aa, Homo sapiens
QGTRTSSQLRSCGESCPPTRPSTASPAWRHTRALTPCPVPSTTSPSPRPCMARATCEAPET

SEQ ID NO: 2408 - protein, 125 aa, Homo sapiens
RGMRANAGFWVILATRGSRVPREMWVPLESKASLDHRVPRASGATQAWQGPRERRALMDIKAWWALSVPLGHRVRKVLGDRQAELGRRVTRAAQVFVDPRGSQARKEQRAPQASTARMGPQARLA

SEQ ID NO: 2409 - protein, 96 aa, Homo sapiens
LEPRGSLAPWGSLESRASPGFLVLLAFRALVLLDLLGLLDLLASLVRLESEAPRGTLDQMDHRGPQDPLGNLVAREPSRVWKAVRISCVQPTVHPE

SEQ ID NO: 2410 - protein, 194 aa, Homo sapiens
RVCQASLGQKEALETRVSRARRAFLDSLVPLGKRESQGLEEKLVPRASWDRRVTKARGVQWGNQALREGRALRGSRAPPEFQGPKACQASKETRAPQGRPGPAAKWVTQGWPASPERKARRASPASRGPRDSKEYVENPATLAPAGMRAPQGFRATLVPPALEDWPGTEACQDSPGDRAWRAGMPLTSTSWMWR

SEQ ID NO: 2411 - protein, 66 aa, Homo sapiens
CSLWRRLEVHRESGAPRVPRDRRECLDPTASTVTMGPLEKLALRDPRASLAKLGQMGQTGSPGLMV

SEQ ID NO: 2412 - protein, 50 aa, Homo sapiens
DIPKNTLTAELKGHHLLKSCGSCQTIFSSQPHTMEAESQSIKMEPWKLGM

SEQ ID NO: 2413 - protein, 99 aa, Homo sapiens
VNPGTITSILTLLKYLAPPRSLQIHTQLLILSFRSLEIVQLTSRCSDALGGRGKLAEGGGLSAHIELQFCDGIDTAFSGQQPEVLLKKALLHSQPQCSM

SEQ ID NO: 2414 - protein, 20 aa, Homo sapiens
INSISLGRKPILAQTILRNC

SEQ ID NO: 2415 - protein, 19 aa, Homo sapiens
RQAVSYGLSCSFPVCQANH

SEQ ID NO: 2416 - protein, 110 aa, Homo sapiens
LLLCVRRRLEGQDLPLTRVPVRCLHLQQRWHLLRQRRHLPLRLPPRLEGQHLRRRQEQQLPAQPLCEWWHLRGQRGLLLLHLPGRLGGSYLHSQYQRLQPSALLQWWHLC

SEQ ID NO: 2417 - protein, 175 aa, Homo sapiens
SMAAGQTRGLGCLAQQPPACVAPMDAASASQGATFPASVTVALLAPTAMRTLTTAWASPAAMGAHASMRWTPSAASAPAAGRASSATPIPTTAFPIPATAAAAATTWSMTSTVRATTAGRARPATHASSSAMPTPAATVAPATTAATPSAAPAPPAGRAAPAPSPRTAAACPTPV

SEQ ID NO: 2418 - protein, 327 aa, Homo sapiens
SRARPTPSWPPSPSGGTAHCSWLSPRSRWRRLLRAALPQVCWCLCCVVPSACCGWRAWSCACGGHASAGKSGRGAGCRGRRAPTTSGPRSTPSATPLSGRGATRTCSTSARTSRRRRAGRTRRCPGRPATRPSGRMRRTRIWAAVRRTPWRRRSSSHTNSPKILAARRGGRPTGPQAPKWTTARSGASMRPATPARSRGGCQLGRDPGPSVGAMPSAGPGGRGHVHSFFILCKKTTKNKNQMFIFYVSLTLYKLFSNCQAENNGVFSDSCYFCKVSVRGTRCMKGESKGCLRRHQIVAFVTRGCALFTESSFYSSLGFLCGSRPKCR

SEQ ID NO: 2419 - protein, 43 aa, Homo sapiens
SNLESPSCRMGHASMWHLICTSVVNAAWSGTGSLRNRSKMILL

SEQ ID NO: 2420 - protein, 22 aa, Homo sapiens
DRPEGNSRAPDGEAGPQWGAQC

SEQ ID NO: 2421 - protein, 92 aa, Homo sapiens
YLVFWAQLLPVGAQASLPWGMAAPARPPAASLSPLRCQLSPLAPQRRGQLWGLGSRTIPSSKPLVTSLAGTQAAFCPPRQIFHRRTKLLLKL

SEQ ID NO: 2422 - protein, 78 aa, Homo sapiens
RSRGFMMEKRSQVLYGTSMQPRMQRRSGSCSERLEKNKAKRTPLIMTQFMTKVGTWTRPSVSDSMRSMACKAGLLCSS

SEQ ID NO: 2423 - protein, 274 aa, Homo sapiens
SALLSMRSPLSSNNWKTSWAEKSVSHPGKPHPGYNLLPPARTGSREAGSQNPSGLVPRSPWPGRAGSHQTMSSVRVLERPRPGIKAYGMSQGGGPAGVSTPRRDPRGQPPKSTVMTQTSLTSPPTESALLVGGGAQGRMLAAVVMGTTSQPAEKTPGLPGRRHGQGGAVSRSTHFTSHGAPSVPSTAPTGDASPTRSSRGTSWMSSCSKRAAGTATCPPPRRGSSQGCREGRMATLERQTLGVTLKSPSCLMDSAWSLTSSLPGGTDTMSASTE

SEQ ID NO: 2424 - protein, 74 aa, Homo sapiens
HKALCVAPRCGYPEHSHAWGAGPPRQQELSWQERLLPVDLPLPPTTPAVFCYSKHKTAGGLPSGQDQGSELLDS

SEQ ID NO: 2425 - protein, 121 aa, Homo sapiens
GIRGQTLWLGPLGATLWPLGALETSHVLWALWRALALHGGAGRHCLPCPLPAAPALVCRLGPGCLLLGVWPRAPVKPWRHCVCVMGSEGLVGAVHWSSSLPEAAISMAPFAAEDTHCGSVG

SEQ ID NO: 2426 - protein, 87 aa, Homo sapiens
WMRAAGSVGPPSLKQPWGLQLWREMVWCMLWGEWALTRPPRPRYVCMSPVGTAGFRYPPCPHPAMGPPPSCTGTRSMSWGAARASSR

SEQ ID NO: 2427 - protein, 74 aa, Homo sapiens
CLQEVAGPLLGKCSPPCPLAGSMAQWHTKMGTCWCWGVVAGLDCPWTLLRHWTWPRTHGWHWHPCPLPGLVQLR

SEQ ID NO: 2428 - protein, 57 aa, Homo sapiens
VGWGFLGVLRAPPHQDGVAVARPVTARPAPRGAVGTCLGFVQLCHPMNLEDQEAQGA

SEQ ID NO: 2429 - protein, 37 aa, Homo sapiens
GPPLTRTESPWQDPSPQGQRQGELWGPAWASYSCATP

SEQ ID NO: 2430 - protein, 165 aa, Homo sapiens
TCASHYLPSAQRIHQMGRKAQLVNLPPVAHLKLAAPTLMSGQMSGLMTCAPRAQKSHWTHLLQRSSLALNPAPCPFHTRNFSESGALPILRTQTVTALNWTTPTALMPCGPQLPSLHESHSYSLYIEKYLYKLYIYTYIYIYAPHNQQKDGAVPAVSQARGRLIP

SEQ ID NO: 2431 - protein, 60 aa, Homo sapiens
IVVAQQIAVPKCHLSWPLQKLEAKISAIKSLCYSQRKKKKRTGTKIKFALKNQSKKRRIR

SEQ ID NO: 2432 - protein, 43 aa, Homo sapiens
KDHLYKDLLQMQEKAVEMKGKSPPQALEDRLPPAPLALRNQVE

SEQ ID NO: 2433 - protein, 91 aa, Homo sapiens
QVALQHWVKFQNLLPLAGSQMQGEKPVWTVHRIRMMLCCMLAQRLPYNIAACPALQNPAPVAFLAEEATDPVPAVLIPTSAASLLGPPPRN

SEQ ID NO: 2434 - protein, 19 aa, Homo sapiens
VMVISLGKVSGLMTSTVGT

SEQ ID NO: 2435 - protein, 54 aa, Homo sapiens
NFSVTAVKIEDAYCSVQCGRIGCFLLAISILKILRNRRLPKWSTISSGFFCIMQ

SEQ ID NO: 2436 - protein, 24 aa, Homo sapiens
SGGNFVKKLYTKCRADGSSSFIFI

SEQ ID NO: 2437 - protein, 20 aa, Homo sapiens
MGRLESLGGYPLNSPFQGHL

SEQ ID NO: 2438 - protein, 15 aa, Homo sapiens
PEYTNQCTLFCGNSR

SEQ ID NO: 2439 - protein, 67 aa, Homo sapiens
DLDIRVPSSLNLRVIFIWQNIINRCYMMGNLQVALPLHIMLRPLMLSSAWNHHQKRMHQFLCIPHML

SEQ ID NO: 2440 - protein, 43 aa, Homo sapiens
DDVTSIWKFFAAVFSFTGPTFSSSKSYCRCSEPFPGNSRFSLS

SEQ ID NO: 2441 - protein, 27 aa, Homo sapiens
LSIPGTAAAAATAAATAAATTTEHFIQ

SEQ ID NO: 2442 - protein, 94 aa, Homo sapiens
CHFNLEIFCSSLLIHRPNFFILKILLPMLRTFPRKLKVLSFIVQILLSTVRLLQPPLNKCSLQCFTLKVPLLCYRALQFLKTSSQPTYFFPRVP

SEQ ID NO: 2443 - protein, 76 aa, Homo sapiens
APVPTMITLRYLVNHENEIQSRGRGSNDEIVKNLIWIYLMPTVPKHLTMCFLSLPRTTKATQKREMEHWKTKKELE

SEQ ID NO: 2444 - protein, 43 aa, Homo sapiens
QTLDIIEFWSFGRMDKFNIALEDPTLEEKMEYFQNQLLILHRV

SEQ ID NO: 2445 - protein, 31 aa, Homo sapiens
HGTKKGIYFMLQTPTITRLKLWIQKQKTVQH

SEQ ID NO: 2446 - protein, 48 aa, Homo sapiens
QPPTARGLLVSYTEMPKSPTHPMKSLSCYCSRKAVAQILVTACLPLRS

SEQ ID NO: 2447 - protein, 113 aa, Homo sapiens
KQMILIDLYLIQAPLRVPQSLNASNLQRALNPKHHNQNQEPPPHLFLLLTMSLNWLHQKSWLAWHLHQVAIQASLKRQHPLSLQLSFQVHCLPEVAKENLKSQKENPHYSNPL

SEQ ID NO: 2448 - protein, 83 aa, Homo sapiens
VCTTAPRGTSSATSSSQPQGHPAWRSCTATPGRACKPCAENTGAGAIAESKEQLPPFPLQLLHCQPTLQLTARGGVSLRTVTF

SEQ ID NO: 2449 - protein, 38 aa, Homo sapiens
HPSLEFVMTDVGVGVQSLLTSSILTHRTRLAFAGNMKW

SEQ ID NO: 2450 - protein, 31 aa, Homo sapiens
KTQLFFLTQQMLNQTDDHMEIFYCFLIISYV

SEQ ID NO: 2451 - protein, 69 aa, Homo sapiens
QMPILYQGGLQFVSTSEVSAWPNWIMLTFFMLMPGPPISHGGENLPQKKDLLLLLQKDRPFCWIKAPLF

SEQ ID NO: 2452 - protein, 242 aa, Homo sapiens
AAPLGAPPRAQILSVRQSQRAWALGRLGSPSRRKTNFTAPWAWSGLRRSYRRPGLVEGRSQAAAMGRKTLSTTASPPTTSITHCPPTCLRMHAAARHPRAQDGSLEGAREPPRLEKPRPLRRGRKMRMRPARLRGPGLSLSRPLSPHPPRCSSFSKRMTVLTGRQRGPVHLPLHHCPTRRRLLGPPKGPRLEPRWRRRRRRRWRWPVALQGVTTGVPRGAPCPKPSLGTAATTFRRGGASGA

SEQ ID NO: 2453 - protein, 234 aa, Homo sapiens
WTSSCGLSQSQRAWALGRLGSPSRRKTNFTAPWAWSGLRRSYRRPGLVEGRSQAAAMGRKTLSTTASPPTTSITHCPPTCLRMHAAARHPRAQDGSLEGAREPPRLEKPRPLRRGRKMRMRPARLRGPGLSLSRPLSPHPPRCSSFSKRMTVLTGRQRGPVHLPLHHCPTRRRLLGPPKGPRLEPRWRRRRRRRWRWPVALQGVTTGVPRGAPCPKPSLGTAATTFRRGGASGA

SEQ ID NO: 2454 - protein, 108 aa, Homo sapiens
LSGICSGRSPWPCSLEFSCTWESPPLTGSSSMSGCICCSCRPNTTQMSLTSRRSGPSVCTCSRPCSCSAWPCSGPSCPQLPPWPSPSSSSSQCRSAWWCSPVSSPTER

SEQ ID NO: 2455 - protein, 228 aa, Homo sapiens
LSQSQRAWALGRLGSPSRRKTNFTAPWAWSGLRRSYRRPGLVEGRSQAAAMGRKTLSTTASPPTTSITHCPPTCLRMHAAARHPRAQDGSLEGAREPPRLEKPRPLRRGRKMRMRPARLRGPGLSLSRPLSPHPPRCSSFSKRMTVLTGRQRGPVHLPLHHCPTRRRLLGPPKGPRLEPRWRRRRRRRWRWPVALQGVTTGVPRGAPCPKPSLGTAATTFRRGGASGA

SEQ ID NO: 2456 - protein, 175 aa, Homo sapiens
GHLYPEAERSQWILGDCPRKEGLGHQPPGREEPLPCVDDGCQPAARHPGLHSHLHGDTDHHAHHLQEGAHAAEGLRLPPGPAAHRGHGRHLCPLWPALVGCCHCPLCHSRQRAHCHEQGCGTWGQAQDSGSQGAAGDGAAGCPACGPLHSYRGSAPADPPGRALWNFPVHGSHLP

SEQ ID NO: 2457 - protein, 54 aa, Homo sapiens
KKTRTSLHQATRKHIIIPLERRSPQAHKLWMIVIIKDIFLMKRFLTLASAHVGV

SEQ ID NO: 2458 - protein, 81 aa, Homo sapiens
ASIYPQTSVPAAVSAMTSFLKINYQIASLMLHCLQISYPLQFVGTSWWKWERTVIVGHLRNVPIFAVMLRHVKSKQLFNVH

SEQ ID NO: 2459 - protein, 77 aa, Homo sapiens
LLSGLPLLHCGWGAVPNGGHFCGGCYGNPAPELQRKAEERSEATIYHWHQATQTEEETPDGKGCSTPRDESDEAPCV

SEQ ID NO: 2460 - protein, 30 aa, Homo sapiens
KPGFREREGAFRGAGSTKAAVFSWKREAVL

SEQ ID NO: 2461 - protein, 30 aa, Homo sapiens
LWSSVRLRASLMAMQMKKLFLKGKFRKKLI

SEQ ID NO: 2462 - protein, 76 aa, Homo sapiens
NYRSYWRAMRKNRERKKRKEALKMLKFSRQLLSYFIAMKKVDFLMNSRLLELNQWLPKQNLPVIKKRLKNFKKSFW

SEQ ID NO: 2463 - protein, 65 aa, Homo sapiens
MRLKNINWILCKHDSKWKKIGRFTGKHCRQNRRPTLRDRKKCMSSSPKWKIFSASWKRKDNKFIS

SEQ ID NO: 2464 - protein, 34 aa, Homo sapiens
NHVQQSRGMERKLTSPLKKAFIGCYMLLQETLMP

SEQ ID NO: 2465 - protein, 25 aa, Homo sapiens
SLRMKENLKERKKTKKWRKTVMAAT

SEQ ID NO: 2466 - protein, 62 aa, Homo sapiens
MNASKKRQQSSVLLRNKRNKKELNECENYEKKENKMNRSRLNSMEPVVWLSWTQNQRILSSQ

SEQ ID NO: 2467 - protein, 61 aa, Homo sapiens
MTVLLRVQRHPHPLLLLAGEPLKSLDFQNLSLLVKHIIMISIGSHCLPWLCHSDLTVMLMM

SEQ ID NO: 2468 - protein, 34 aa, Homo sapiens
WGRGLDVISMSLQLFQNKVIKRAKRAKKTGTWMN

SEQ ID NO: 2469 - protein, 34 aa, Homo sapiens
WPLRLDVISMSLQLFQNKVIKRAKRAKKTGTWMN

SEQ ID NO: 2470 - protein, 76 aa, Homo sapiens
HLLVQLRSWREMVPTPSLPLPLLLNGSSFVGSSLGGSQCYCGLERFFVSWLIASKLLQKRNLKTIICTWVWCYQPL

SEQ ID NO: 2471 - protein, 70 aa, Homo sapiens
QWPTCGLTIKSMKLIRQRIRVVSLLTRLQLPGLLCPELQVFVTGQCFRLTRKTYLFLSGQLQEMPLSQHS

SEQ ID NO: 2472 - protein, 56 aa, Homo sapiens
STTSSPWRGAAAPSMGTSWCRGTARRSHSQRTGRGPPSPRQRCASPAVAPSRVACS

SEQ ID NO: 2473 - protein, 50 aa, Homo sapiens
HRLPSLSRANSEVTMNKKNSSRADGLLCSSKSTTEVIRNVAKDGRLAGRL

SEQ ID NO: 2474 - protein, 170 aa, Homo sapiens
NPCSMASSGPAAMGTAAQASRWNSWCSRSSTATRPSPSRGPTTASAPAAWELAAACITSVTAPNTASSRPRWSHGQGGTGATRRCSTMTCRRASTSTATARAPAVRRGTARWPSPCSCTRAAPRSPPPTRWKSPTPPRAPLCPSAAGSTATRTWWTARWSQVCPVWRWPL

SEQ ID NO: 2475 - protein, 144 aa, Homo sapiens
SPVPPPGGAEGHLLHPPKPLKPSPCPTPSSRGQRTALQHYPQSPVPADGSPAVRASPPSRGARAPGVAAESSGWGSNGGAKVPAPHTHLLRLEPQPALPCHWSQSWAAHCMPSTLAWQGYQRLKDTAQISIFISHITFPGNWTG

SEQ ID NO: 2476 - protein, 92 aa, Homo sapiens
WRLRDPRKKRMVSRAPLRMRKAGPLQTPPLGLGDLLLHPLLLQGPATQPWDPARPPCSPCRLNSFWTWWLKPSPAAWRSRGPPSTPPKTPQA

SEQ ID NO: 2477 - protein, 130 aa, Homo sapiens
EEDYLRFLTSVSMETKKVLMNIQAPAFSLRVLMTMSSVIFHSTLSNKCEPLSPWCPLVGSRWFTPCRQPFPVYILHPHCPCQWRALRRRKARQGSPSPRTPMCFLSSMRSEVLTLCSHLVHLALPPLLGC

SEQ ID NO: 2478 - protein, 41 aa, Homo sapiens
CTEKTHQVPYWGAAISMYTLWFLFQDKEQFVQAQEVTCPCN

SEQ ID NO: 2479 - protein, 27 aa, Homo sapiens
DKKLPQGLEKLIKHQVDGDRNNQLLLR

SEQ ID NO: 2480 - protein, 66 aa, Homo sapiens
AHRVLHYQQEMVSWKRKGRATSGLLACWSAWPLPPAGTWQTQLFFSRTWQISSRFFSSPVCGQQLL

SEQ ID NO: 2481 - protein, 32 aa, Homo sapiens
RTAQTSRKLLHPLLVHLKKLWLIHTMGMSFTS

SEQ ID NO: 2482 - protein, 31 aa, Homo sapiens
ILWSEERREGTTCRQRFLPRKTSGLLPFWQA

SEQ ID NO: 2483 - protein, 28 aa, Homo sapiens
PENFLQRFRINFFYLHRLALSKNVFHHG

SEQ ID NO: 2484 - protein, 94 aa, Homo sapiens
NLVLILSSWLVNNTLYLYLLWKDWNLMPYLIFLSLLIPTGERAPKHLCHFEHLKQFHQHQRTPEYLYYQVENAATRMKLWWNLGGTNLSMKMGC

SEQ ID NO: 2485 - protein, 43 aa, Homo sapiens
AFSTRSGSFIAKQARAQRKRCITMRRRDQLLKNSLIFWARESD

SEQ ID NO: 2486 - protein, 42 aa, Homo sapiens
FHGHALSLYHIQRLRTHVPRVNPASLHAQQQTTATEEKAHRK

SEQ ID NO: 2487 - protein, 24 aa, Homo sapiens
SMQKMQPINQKSFEQWPLERGRST

SEQ ID NO: 2488 - protein, 90 aa, Homo sapiens
GARRTSTPKRTWMPMRVMGKVTTSSLVVLTLEMRLEGKATGGLRSLEPTHPLSVLGKAALSNRHSALTAQMQVSPSWKCPEKTSLFTGRK

SEQ ID NO: 2489 - protein, 41 aa, Homo sapiens
CRCPHFGPFFFLLCFSCLDWIASLLKLKDRSHPWLIFTHPS

SEQ ID NO: 2490 - protein, 72 aa, Homo sapiens
GAVPCESQVPADPKGTQPLGCGARGSHTLQLSHRHERRSRETDPHHCGDHDVSSLGSTGPAAFLLFTNIRFS

SEQ ID NO: 2491 - protein, 40 aa, Homo sapiens
QNTRKFYMFLKNPKWNYMRKKLSYLNTSHFNKRCCPMNHQ

SEQ ID NO: 2492 - protein, 22 aa, Homo sapiens
KRWTQPRCALSCRALIASGLTC

SEQ ID NO: 2493 - protein, 21 aa, Homo sapiens
TKACPGPELNSGLGRDQAPEV

SEQ ID NO: 2494 - protein, 18 aa, Homo sapiens
RVLYRKNVSASGRTGTGD

SEQ ID NO: 2495 - protein, 56 aa, Homo sapiens
ILLGPTIIVKKHISTFHFHSVWGQKKVSVITMKLWEKHFKGLNWNLVVWILNLKMM

SEQ ID NO: 2496 - protein, 114 aa, Homo sapiens
TRRKEMDKADVYWGIPYPSYGVWHCLLHQFHSHLLPCFKSHSFWNNGGRLLHLFFCYSSSKSCWYNTWPKSVRSAQLSLSCQCCASSYTGEKMVHGACGYCLPGWNFTFWFNLY

SEQ ID NO: 2497 - protein, 139 aa, Homo sapiens
LTVMMKKRMMMKMMENMRIMKRMRKMMMMMKMTQGWEMRVKIVMKELVVPMAMMVMKLMMLRVVMGLIQVQKQKKVWVEVKVITELLILKTVVKEIQVLQNLLFLRRFLENNSHHQHLKDRPLEHLSHRDAHHIHFPQD

SEQ ID NO: 2498 - protein, 71 aa, Homo sapiens
VACNSIFLMMKTEQFQVLQLLWCHIVLMDLLKQFIRRRLLVSLDSGLGHLKICHKQVLVTLILASLLLKEV

SEQ ID NO: 2499 - protein, 58 aa, Homo sapiens
AGTPGLPTPPLAPRQTAAATAHHRTPRRALKSLPQKRARTPPFTRSLMRISRRNPHPP

SEQ ID NO: 2500 - protein, 30 aa, Homo sapiens
ADQVLTRDETGEEDALPRRAAGPAAAGKWL

SEQ ID NO: 2501 - protein, 70 aa, Homo sapiens
TVHPPTAVWAPPRMDGLNSEARVAAAPSAGLLARRTSLAPHPSPPWGAPYPRHCLTDPRPPAPAVTPWPY

SEQ ID NO: 2502 - protein, 336 aa, Homo sapiens
RLLSWRRPRVAAGQPRCRQLRARSLPQRQALPRERATEGGLPGRWGLLAFVKTRKPERGPEVPLEARSLLRKLEDRVASSQTSLRTQAPAQRAGAAGRGGLSRAAPVAAASSAPRTRQSTGASTRGRNRTSAATAGRPSSTARTWSGTSGRTAGRGPTRAPSAARPSARASTSSGTSACTRARSPTRAPTAARPSARGRTPPSTAAPTPGRGCTRAASAGSASCTARTWSGTGGPTTGRTRTSAGSAARPSARAPTSSSTSACTRGSGPSPARTAAAPSAAAPSSASTAASTPGRSPTSAATAGARSGRCRASSGTSDSTRARSRSAAPSAAAPSA

SEQ ID NO: 2503 - protein, 243 aa, Homo sapiens
LNGPWGASSLLALRAWSHQKKRRIPTKKCTRTCGWNLRQLPTHHLHQPKSPGRAQRRSPRSRRLLMSAQESGWCTRCGRSAGTLRTSASPVGASMLPWNTPSSLEECAKTARTAFWSVRTSTTTTATSPTAPSAVGAVRCSCAETTTAAGAFAWSVWTSWWGRGLPRQPLRKTPGTATCAGTRVPTGCCGGERTGPPGSRCSSLITTTRNLTLQRFTHLSQLRRGSPSGCCLSLMESLQGSWC

SEQ ID NO: 2504 - protein, 114 aa, Homo sapiens
SPSPHPWPRTQAPQSYYPMGTWRSGVSPSQRRGALLGGRRAGPQQRERVQLRPCLKPQEQWKMAAAPPRRAEEPLQKRVSPQHQGQPLLGPPAYPESQGLGSPAGPRKDGLGRG

SEQ ID NO: 2505 - protein, 70 aa, Homo sapiens
CPPCPPAAPGTPAALLRSGRRTERTERSRRSRVARRSAKSPAPRHGRWGGLGGSASTPRWKAVTRQRTLR

SEQ ID NO: 2506 - protein, 22 aa, Homo sapiens
PTWESSPSTPLPTGARTTSLAS

SEQ ID NO: 2507 - protein, 83 aa, Homo sapiens
APASWGCPRLQGRSARRRPRPAWCSHRRVTWRPCIPRYPPTPTAATSTQSPCLSTTPRAIPGSPIPPRITNRPSRRWTAISSP

SEQ ID NO: 2508 - protein, 46 aa, Homo sapiens
LRRCSFPTSSRACRSTGGVRRTAQPQQRKEVSTQKSSSLEQGLPSR

SEQ ID NO: 2509 - protein, 41 aa, Homo sapiens
ECHLSEVPRKGRCPRGLGGSHGPSICACGQQVPAVDGEVWA

SEQ ID NO: 2510 - protein, 76 aa, Homo sapiens
MRTVPQFTTFAATRFKPSSTSSTRTSSPCSPVSAVRRRAPPSVCPWFRVNASSSTSSVPGGSGRGMPLLLAILRNS

SEQ ID NO: 2511 - protein, 75 aa, Homo sapiens
MRTVPQFTTFAATRFKPSSTSSTRTSSPCSPVSAVRRAPPSVCPWFRVNASSSTSSVPGGSGRGMPLLLAILRNS

SEQ ID NO: 2512 - protein, 44 aa, Homo sapiens
ISWWMKQQQSTQTRNPSNWCKKRIHWRRKKQWRKMKRPSTEMLT

SEQ ID NO: 2513 - protein, 23 aa, Homo sapiens
KGGQREQQKQKGSEGWVKGGQTP

SEQ ID NO: 2514 - protein, 18 aa, Homo sapiens
RGVRPHRTSSSKRCCGSE

SEQ ID NO: 2515 - protein, 61 aa, Homo sapiens
APVVNTSIGKVPGLEANEATLGLCVLRDHLLATSALLQWALTKNRLCRNLGKKRALRKERN

SEQ ID NO: 2516 - protein, 35 aa, Homo sapiens
VTRAHCWKMERSLRQSLLEPVPPSLPNSVLGWCLN

SEQ ID NO: 2517 - protein, 232 aa, Homo sapiens
WAGCLTEVVDPMKSNLHPQRCHRGRRGKMAPSSKQEAEEEGEVAMNIPHTEDEEVMNKEAGEVDVVAMTMVAEGEEEEISIKEAGQMEGVVEEVATKMVVIEIQVSSQVAIMVATAVVAIKAEVMVASKHLLHIQEVDTRVVATSRTIDTKMAGTMVIVVVVVVGEVVVEAEVVVQAREEAGEEEGARIITKGVNLNSISSMEVISIIILDLDREDITLVEATEPYILLELK

SEQ ID NO: 2518 - protein, 18 aa, Homo sapiens
MLLQKKLKKEAVVRSFKS

SEQ ID NO: 2519 - protein, 46 aa, Homo sapiens
KEKKQGCLSQLQQHHRQHSGKLQLTQHCFSKPRLCKDGEQRRLFRA

SEQ ID NO: 2520 - protein, 42 aa, Homo sapiens
KQLGIFLKRKKTRMFIPAAAAPPPAQWETPAHTTLLLKAPTL

SEQ ID NO: 2521 - protein, 284 aa, Homo sapiens
EAFPAPPTDPGSPPAPPLPSTCCTRRPAQPPPRPSAWGPCPAAASPGGLPQHRPRETPLRSAAPASSSLPTALGPRLCRGTEESRRRGPGDPGTLPVLQPSLGPQPWEEGKGLASPPGGGCISFSIESIMQGVRGAGTGAAQSLSPTAWSYCPLLQRPSSLSDNFAATAAASGGGLRQRLRSHQGRGAGRAPVGRVGAAAVSGGGRGLWADIAGRPFGRRGDLTSFFSIAHAQFPGRVRRALLEPGGSGERPAAAHSTLRGPYWACASESRWRANTNFCSLQNG

SEQ ID NO: 2522 - protein, 37 aa, Homo sapiens
RCPAAGKAPLLVHRAHHHGHPAKPAQAPHAQRHLRLH

SEQ ID NO: 2523 - protein, 148 aa, Homo sapiens
QHLRRRPGQWGPGQRGLPDGLFPSPGEFHSLHRVQPSAGGCRLQRVPRGVRGCGRHAGVGVLENSRRPGCQCGVHQGAGWLGFCGAGCGLGRECGWGSDSGDAAQGHLQRLCGLLRHLSPGIPVPTPGHSAPVPKSLHGGRVCLPQLQ

SEQ ID NO: 2524 - protein, 71 aa, Homo sapiens
PERRVWLHAPPGGDTSPGVHPGFPGPDSDLHLRGHWRPHPHHQLEAQLGPHPLSSQGDSDQRGWPWHTDHP

SEQ ID NO: 2525 - protein, 79 aa, Homo sapiens
LRKEKLQTKKRLKPKGIRCPKSRVSPQVPQEPAHLQLWIIPHYPRPHHQLHPTLRLLRIRKPRPNGRWMQEEMFPKTTQ

SEQ ID NO: 2526 - protein, 66 aa, Homo sapiens
APRSLRSQHICSCGSSPTTPDLIINSIQHFVYSESGNPGPTAGGCKKKCSPKRPSDSGGTESNSAI

SEQ ID NO: 2527 - protein, 51 aa, Homo sapiens
SPRNQFLMIKRSQMMIKKRERELFQLGNPKRKKRKRRSKVKITLLHRTQKN

SEQ ID NO: 2528 - protein, 21 aa, Homo sapiens
MFKLATLNLEKEILHFRFLQD

SEQ ID NO: 2529 - protein, 97 aa, Homo sapiens
RKGQRWQNLKSINSKLKQESLGKRFKKNSIPCFERTTAGEVQGRCCFMAKNLGCMETFLKTCLNCFSHHINKAIRKIIKGNIIASTVNGDFLILKCK

SEQ ID NO: 2530 - protein, 24 aa, Homo sapiens
TIPSTDLESLRCFLKLGFWANWKQ

SEQ ID NO: 2531 - protein, 23 aa, Homo sapiens
QCYTIWGEETKERSFIPNGCISA

SEQ ID NO: 2532 - protein, 49 aa, Homo sapiens
LLIAMLPGQRHLRAVTFFAEQPGIALRITQEAGFGSLRCLMNAGQRVTC

SEQ ID NO: 2533 - protein, 41 aa, Homo sapiens
SCRWRRGRTRSPPASPARGCSCVSSAAGSRRAHSCGARCGR

SEQ ID NO: 2534 - protein, 21 aa, Homo sapiens
SRTSAGTGRRRSRCPSSWGVC

SEQ ID NO: 2535 - protein, 178 aa, Homo sapiens
ANEEQRGPVPAGLGPRGVLDCVHDSEAADGEGGGPGPHLPHPHGAVPAFPLQPVPAGRTAAGRAADAEPPGRAGPVGADVRVPPRGPGKARGAGVRPPSVPGRRHPPPGQSLQRLLLLHPPQLPAVSHCPVLRPGEGGGGGQGRPRLGHRGRTEAAFRRRKTQEPRPDSSRTLLIRPR

SEQ ID NO: 2536 - protein, 278 aa, Homo sapiens
MAAHAICSAGIPMSAPVKSGLQVRSANGRMPACLIPVQMEVPVPLWPTSSPANASQASQGRNVRLMSMSVTFQDTASMVAPASTCLVPTSASALRASQASTVTACMCPVHPHLVSMEAPVGRLVTSLLSATAFQVLKGAPVRGILMTALTTGVRMEGFVWMGSTLTTAAVPHNGQDSSAQRMWMNACCSPMPVKMGAPVPTAMEAMAVYVSTAGVEMTAVRTLMIVPSPPVLQAPPASTVWPPSLACAQRGRQVSCVIWMMHASAILATRGHCVTPTP

SEQ ID NO: 2537 - protein, 32 aa, Homo sapiens
KMGPTETCRTTRKRHLCFLLPGRGAMKQPRSC

SEQ ID NO: 2538 - protein, 98 aa, Homo sapiens
QPPGEVCLLNTCASTQVSASMLATRITVSAPWAILGATVRSNSMSVRPTPASTGQHAVTSLVDTDASVSQAIRVSTVSMKWMSARISPARMEAPVLTL

SEQ ID NO: 2539 - protein, 68 aa, Homo sapiens
VATLATVCCHTQARIVRQYWLPVPQTLVRMLLFAKSHQILRVILACVLLAGKVSGVPLTLTSVSPSPA

SEQ ID NO: 2540 - protein, 117 aa, Homo sapiens
VTNLPCCSPTCSTSLAPVMAPGSQRAPQGWSVSAPCPRLKPLPSSAELPPRAYLGTTLATPTGTFQGLHLPSFFKTLGCSIWPRSCQHPAGPGCQGCQSKGAAAGQRTPQRAMRRKD

SEQ ID NO: 2541 - protein, 116 aa, Homo sapiens
SLNWKHRQGSKSCRQEWDRGRRQLQSFPKLRTAPHPCAQCCSLWWPWQVWLGCWWLWLWLCVCGSMRGSKTRSAWQPWGLRGPMVTLPLSTRTCAASTWPRSPCSTGQRVHRSLHG

SEQ ID NO: 2542 - protein, 93 aa, Homo sapiens
SLRRWSASPGFAPQSPVQGTGLAWHPRDLVLLESCFYRTSPLAPPLLPSIGFHNHQWAKVELGPAPLCPLCRLSCSRLSWSTCCCPHSLPTLH

SEQ ID NO: 2543 - protein, 14 aa, Homo sapiens
CPKDCPGTMTSPSM

SEQ ID NO: 2544 - protein, 79 aa, Homo sapiens
AAARGAAAPLVPTAVYLTAGSALTWKSVFRMACLGSARWEWGRPGPFCKSPPQFSNAYKVCSDNSCPKDCPGTMTSPSM

SEQ ID NO: 2545 - protein, 105 aa, Homo sapiens
RGSPAPPQPQRRLFERDVLRSQPQPNGRGALAVPVPAPPLHLPPPPPPPLLPPPLPLLLLPPHLPPPRRLPPLPLLSLALRPCPNLQAPRSHPLASGGPAAPGSQ

SEQ ID NO: 2546 - protein, 91 aa, Homo sapiens
PPENICARKSCSVQDCTCPDSYQSWHRSASSVHVCCWPCCKNVPGSSPGASHESQNRTSSQPCQQDSCSLCGSHEPSQRQDTCHSNSSEPG

SEQ ID NO: 2547 - protein, 80 aa, Homo sapiens
KIYLERHLEGEANVILPQNRKLCLRLLGRGVVLHHPQSSTTSVLPPREKEAGQNHQLIRKLWLGLPWGREVVRDPLKNLM

SEQ ID NO: 2548 - protein, 61 aa, Homo sapiens
TPSGTLGPSATRLWSVAVPRPSPHHGTSRAAAVSGVPGEASVGTAAPPATSAGGRHLALGP

SEQ ID NO: 2549 - protein, 127 aa, Homo sapiens
NLQITSGLYPGRSPACALKFWRTVKTVSAGDTQAWAKLSLLGALQSASLRLSLWLEPSLQSISFHLWKNVINGWYLSFQRLLLTLAMTQTNQTKVYLMPQQTPWAVARRWCNGPSLTGTEQAWICQP

SEQ ID NO: 2550 - protein, 97 aa, Homo sapiens
KKHPAAAAERGRVCGSSTGASAHPSGGSLVTPFIPRSLRPGHVWGLVLTAFWLRLVGSTPGWFFSVPPREALWPPGNLLCRALPRRPPHTLALKWSL

SEQ ID NO: 2551 - protein, 80 aa, Homo sapiens
IRTIPKSVAETNPRIFPGRGIRTTCSKYKEHGTQQLVCTHNASQFLRRLFSSSLNPETCKSPAACIPAGHLPAHSSSGGQ

SEQ ID NO: 2552 - protein, 29 aa, Homo sapiens
SCPRLTLMSQDPKWTLKALMLTLKDQRES

SEQ ID NO: 2553 - protein, 29 aa, Homo sapiens
TCPRLTLMSQAPKWTLKALMLTLKDQRES

SEQ ID NO: 2554 - protein, 25 aa, Homo sapiens
KALNLRCQTCTSRPPRSPCLMWTYT

SEQ ID NO: 2555 - protein, 25 aa, Homo sapiens
KGPSLRCLRCTSRPPRSPCLMWTYT

SEQ ID NO: 2556 - protein, 25 aa, Homo sapiens
RAPSLRCLRCTSRPPRSPCLMLISI

SEQ ID NO: 2557 - protein, 25 aa, Homo sapiens
RAPSLRCLRCTSRPPRSPCLMWTYT

SEQ ID NO: 2558 - protein, 25 aa, Homo sapiens
RVPSLRCLRCISRPPRSPCLMWTYT

SEQ ID NO: 2559 - protein, 23 aa, Homo sapiens
RAPSLRCLRCTSRPPRSPCLMWT

SEQ ID NO: 2560 - protein, 21 aa, Homo sapiens
KGPSLRCLRCTSRPPRSPCLM

SEQ ID NO: 2561 - protein, 15 aa, Homo sapiens
ISRPPRSPCLMWTCI

SEQ ID NO: 2562 - protein, 45 aa, Homo sapiens
SSCWKITPTPTWPPPPGTPPCTLQPVRAMWKQSWPFWKRKHPRPA

SEQ ID NO: 2563 - protein, 109 aa, Homo sapiens
RGQTQLQSPEWLYPLTHRLQKEPRPCHGAAAEDGSLDRRGHRVWPDTSPRGLLHGAPSHREEPPAAGGVAQRLQRESGDPATHGSQSRAHGSGQIFTPEQSQSQCQGQG

SEQ ID NO: 2564 - protein, 106 aa, Homo sapiens
GPCGNSPGPSGKGSIPGLHDQERIYPSARGGQVREGAGGRAAAGAGRTPECCRKKWPDPPARGRPSQQPGHRQAAASPGRLPAQPCLEWLHPFAHRCQAEPGGGGP

SEQ ID NO: 2565 - protein, 56 aa, Homo sapiens
FMMMLRMGMKVETAPWNTDGVRVNLKVTKSRVTRSARMGFPGPSCAATTKSKCRSS

SEQ ID NO: 2566 - protein, 56 aa, Homo sapiens
FMMMLRMGMKVETAPWNTDGVRVNLKVTKSRVTRSARMGFPGPSCAATTKSNFLMT

SEQ ID NO: 2567 - protein, 46 aa, Homo sapiens
TEDAEAREGREGRHQGRAGEDQGSREEGPLLHQDQVSHRTGSQIFS

SEQ ID NO: 2568 - protein, 87 aa, Homo sapiens
KSTHILSSTSRHSRRTSRPPPCPALRRRMWVSMCPAGTWCLYPAAMRCPPTCPSCCPPTPARSSSAPRPWTKKQKHQKSQKIASPIL

SEQ ID NO: 2569 - protein, 86 aa, Homo sapiens
KSTHILSSTSRHSRRTSRPPPCPALRRRMWVSMCPAGTWCLYPAAMRCPPTCPSCCPPTPARSSSAPRPWTKKKHQKSQKIASPIL

SEQ ID NO: 2570 - protein, 63 aa, Homo sapiens
LGVQEWDSQVLPAQQPQKANAEAREGREGRHQGRAGEDQGSREEGPLLHQDQVSHRTGSQIFS

SEQ ID NO: 2571 - protein, 111 aa, Homo sapiens
DDLMGTEEGVEGIIKEEEVDIIEVVIDLSGIEGTLGVLDEVVHVPGVQKEDPFLLKDPEADLAGHIDLLGLQDHPLLVLHPHIANLLFLKDEGLRKNKPKKLKGNPKKRVR

SEQ ID NO: 2572 - protein, 23 aa, Homo sapiens
CSHAQYSSLCKKYSFSAFTFHSA

SEQ ID NO: 2573 - protein, 100 aa, Homo sapiens
IYKTLPVRGFCLPLIMQIVQKMTLSSCYPDLPTPLSVAPRKKILQQRFMLSLTHQQESRWLISLSHHSTARLVQALLSTQIEVKGMGNLITGHSLHISHQ

SEQ ID NO: 2574 - protein, 25 aa, Homo sapiens
KKARRADERKTDRRTKKARGMFILP

SEQ ID NO: 2575 - protein, 21 aa, Homo sapiens
TMVKKETDGKNGRATSCQREN

SEQ ID NO: 2576 - protein, 145 aa, Homo sapiens
NPFRPSQRWTAPALLHHRPTTAPPSAHRSRCTEPVGIPTLLLQTLPASTPHPQAFRQPSDPPAKPPQIYYRVQHWTAIRQRGATIRKCRICPTLFSPSQPTTHSSLLISYVLKNPVPDQFFFSLTPDAMRSQGHYHLFINCKNFC

SEQ ID NO: 2577 - protein, 54 aa, Homo sapiens
MISTFSLAPVATRFADFVGIEFALMKMGFVLHVESHIQKTQQFINHSPRKSCKG

SEQ ID NO: 2578 - protein, 92 aa, Homo sapiens
LRRNCPFKTNLPFRPHLFRTPLHTLQPPKVQALDSCILLQLQMPILSIVPFQSCPRGSLNFSSTERFIIHSVFQARQPAILGWPFHAIASCT

SEQ ID NO: 2579 - protein, 22 aa, Homo sapiens
NGTFLVWVMKLMCTQLSFTGKH

SEQ ID NO: 2580 - protein, 79 aa, Homo sapiens
YLVFFCFYVVPQPGRKKSIITLELLKRLGIMPLTMGKRNLFLLTRNIPISIFKMAQIELGDYIRRPFIFSTQMKPLGQL

SEQ ID NO: 2581 - protein, 15 aa, Homo sapiens
KKAPVYFRAHPPPFK

SEQ ID NO: 2582 - protein, 11 aa, Homo sapiens
KKQTISEISEN

SEQ ID NO: 2583 - protein, 59 aa, Homo sapiens
VPRPLTTRCLPSSTACSSCPPQRVLPSWTSTWTGWPPPGGLLTTTPLSLAWTWASSRSC

SEQ ID NO: 2584 - protein, 73 aa, Homo sapiens
WLWSKAPMAPRTWDSALMPMAAWPPWSYNSRPTSGTVRTTTRPSSSTMRSATGWQRSWAWHLQASAVVGSLAV

SEQ ID NO: 2585 - protein, 163 aa, Homo sapiens
WTVTAAAAAAAAVRLPARVRKGSNGPRGSPWPQTAAPRTAPRPRLCPLRQAQREAAPSTAAPWRTLPALQDPHQQLPPSSLWVHPAPWPLPTSPIPGHCRNTRGAVPCQDLGIGQLSAPTAPASALLQPPHSAMGPGSHPLCSTMWSASGRNEPSRCQRAIPS

SEQ ID NO: 2586 - protein, 95 aa, Homo sapiens
PQKGSLQGGIRHWSLPTGEQGNLHPSAYSLRVTKWKVGGQDCHERGQVCAAVHPVFPQMYCGEIPHVCCCLDSLWRTSNQSKPRNRHVHSLQSLV

SEQ ID NO: 2587 - protein, 93 aa, Homo sapiens
MPKMTKVSSLDPGTISMPMASPHRPGLEALTFYWNTGALRIQSGMANAGFLLVSLTHFYDALEYQQELLPIISLPMIMMPICKWTSSWKKMGT

SEQ ID NO: 2588 - protein, 62 aa, Homo sapiens
NQGPTLTWTLKWKMLCWEKTSSSPSPSGTTATTVTPSQLISQPTSPSTPGSRRQNSRRRRST

SEQ ID NO: 2589 - protein, 45 aa, Homo sapiens
RSLCCVWQSFFKSRRSFNWEVPTDISKEETYRAHGRSFCTSCSIP

SEQ ID NO: 2590 - protein, 19 aa, Homo sapiens
GKNYFKILQSFNKPSSRKR

SEQ ID NO: 2591 - protein, 45 aa, Homo sapiens
RRWAGSPPDGRWAAPRAAGNVCPSHARRRAPQSSKSPSAARTPAA

SEQ ID NO: 2592 - protein, 228 aa, Homo sapiens
APGQPGCQLHPQCHPANLQPQPDTECPLAPEATGGRRVRHSALPAGLAPARTPERRRRGGDHNLRALAGFRRGQLRAPARAGGVRGLSLWLMRELQPGPRRRPEGGGREARRMAGGRRPGLRGMCVQAMPVAVHPRAARVLRRPGRLRRDLRHRRPAGALPRPCAARAVLPGLLAGRLPSSGPSWRPLSCSGHLRGSLSGRWGPAPRVEAAGLLSLPVPCPQPLRALR

SEQ ID NO: 2593 - protein, 228 aa, Homo sapiens
APGQPGCQLHPQCHPANLQPQPDTECPLAPEATGGRRVRHSALPAGLAPARTPERRRRGGDHNLRALAGFRWGQLRAPARAGGVRGLSLWLMRELQPGPRRRPEGGGREARRMAGGRRPGLRGMCVQAMPVAVHPRAARVLRRPGRLRRDLRHRRPAGALPRPCAARAVLPGLLAGRLPSSGPSWRPLSCSGHLRGSLSGRWGPAPRVEAAGLLSLPVPCPQPLRALR

SEQ ID NO: 2594 - protein, 224 aa, Homo sapiens
APGQPGCQLHPQCHPANLQPQPDTECPLAPEATGRRRVRGSAFPAGLAPARTPERRRRGGDHNLRALAGFRWGQLRAPARAGGVRGLSLWLMRELQPGPRRRPQGCGREARWMAGGRGPGLRGMCVQAMPVAVHPRAAGVLRRPGRLRRDLRHRRPAGTLPRPCAARAVLPGLLAGRLPSSGPSWRPLSCSGYLRGSLSGRWGPARRVEAAGLLSLAVPCPQPL

SEQ ID NO: 2595 - protein, 88 aa, Homo sapiens
PQPQGSRWLSMGTASCACACRRRTRPLSVAYAGTTTRTPQTTSRLWAGSPLDGRWAGPRAAGNVCPSHARRRAPQSSRSPSAARTPAA

SEQ ID NO: 2596 - protein, 31 aa, Homo sapiens
PWSAWNHPLTLLMTWPSKPKSSMGLSRMGPP

SEQ ID NO: 2597 - protein, 88 aa, Homo sapiens
RRSGGGAAGVLRRKTKRPVPWGSRRSGASSLSWPPGWSSLCWWPWASLCTSSAKQQRESSVPSAAPWPMRSVSPLPASVESSTSLSLP

SEQ ID NO: 2598 - protein, 85 aa, Homo sapiens
PGQANQNRVWGCQGWGHHDLLQEIQDLHLREDVGLHEQQAIGAGEEQRGGHPEGPDGRLRAAHGVHHHRVRHAEELQPHPDRGPH

SEQ ID NO: 2599 - protein, 26 aa, Homo sapiens
HSMGRFARQQRLKCFFQLGSKRQGRF

SEQ ID NO: 2600 - protein, 21 aa, Homo sapiens
MFFSAGIQKTGTFLKNIRNFP

SEQ ID NO: 2601 - protein, 76 aa, Homo sapiens
VDFQVSTTLWSQRTRRRLPRMGYPPGLIFFVCSFNSWRQPWRQESDLLRRIFSILSLVLYLPEWVDSLILAVLSAR

SEQ ID NO: 2602 - protein, 101 aa, Homo sapiens
LHPSLHLSGRCPVSQALTSCGSRCSPSHITGPTMRQKAAEGLSKLQLEATLWFSSMATWKTSLWDFRSSLGQLMSGSLSRTPSTRCTESRGKLSPPPAMRR

SEQ ID NO: 2603 - protein, 89 aa, Homo sapiens
PLNRSRTWTRPTWMMLMKLSGRSFQDLLPEIRRKRSHYSKTPSVSDPSEPSTAPHLLSPFMFISQPGVHTRINVWALSGLSLKELATSL

SEQ ID NO: 2604 - protein, 82 aa, Homo sapiens
TASPRTRLVGSPPRCGRPALTPRRCLPPHPRPACLATSTRPWSSWGPASRARGETRLQNPSCWFRPLGPSRWCLPFPSAASQ

SEQ ID NO: 2605 - protein, 54 aa, Homo sapiens
NVFPGRQHYRERDDDQESREAEDGRPGGTEEAADVGSIEWALGGSSLRAGRESS

SEQ ID NO: 2606 - protein, 139 aa, Homo sapiens
ELSLQATAPLPTATTCHQHPRPGQPPPQVRQRQQPGPGDPEGAALGEDLPRGQLSGGSSVSPGGERAPHGHQAPRHCEQAPQPGGDEQHGAGHGGHDAQVAPPPHGSPQHAPGAGTARGGVRQPRGPPAPSVSPQEDLL

SEQ ID NO: 2607 - protein, 111 aa, Homo sapiens
CLPHQGGGWRGRMALHSHPGAPATHVPRLLADGVGAGSECDCHGHCRGGGWTNQKPPILAQTRFKAQLSHLWQVQGHHEVSNGFCLLCNHGLEGQAPFVWARKDGVAFTIY

SEQ ID NO: 2608 - protein, 60 aa, Homo sapiens
IQYCHHSCFWRKTFFFSLYQWINSAISSERYWYFHKSQFSPDFLVPWFWECGTIPADANG

SEQ ID NO: 2609 - protein, 132 aa, Homo sapiens
TTPHTDVTFKIYKQEPSITSGLFLWMKREQWSCKQILYLLLGLESVKRRRLQPACMFGGLLLPEKSPHMRCNYLMKITKRYRGFKFKKVLHGMNTLFSISLLVVNTILPSQLFLEENVLFQFIPMDQQCHLQ

SEQ ID NO: 2610 - protein, 107 aa, Homo sapiens
LTVEISAIKSQRRAEQLQVLPVLCHLLTLQTHPWPSRGKGPQTGQTTTTLSCSGCPEMHLLSSTPTTTENQKDALCMVFVQGDPINSTSRLSVVIPGKLTANQFLDL

SEQ ID NO: 2611 - protein, 56 aa, Homo sapiens [sequence omitted]

SEQ ID NO: 2612 - protein, 55 aa, Homo sapiens
LFFQGSEYYYLCYLGTFPQYEERWQWHRLQHVEKDSWYLSECPNIRDHREAHELL

SEQ ID NO: 2613 - protein, 23 aa, Homo sapiens
KTLIIFSRKRILLFMLFGDLSAI

SEQ ID NO: 2614 - protein, 65 aa, Homo sapiens
VTVMEFLRRKLGRTGQKGIEKSPTIIMNKEEMSVMNIFFMNMPHMGVIGLSLKRKCLLNGPRSTG

SEQ ID NO: 2615 - protein, 56 aa, Homo sapiens
VCHRGEVRCALLCQLHTWPRQTPHPAPGPVSAPGGHRPWQPRQQCQSHYPVGQCLL

SEQ ID NO: 2616 - protein, 45 aa, Homo sapiens
EHISEGPPEAGGHFQTNTSRREKSCYGTVPPLANAFPLEAGRTQV

SEQ ID NO: 2617 - protein, 63 aa, Homo sapiens
QRFLRALGLVKTYSLLCCLPLNRTSLSFSWRGKGSRGEGPWGHSPSCSPPTMGNLGSQCPTWT

SEQ ID NO: 2618 - protein, 24 aa, Homo sapiens
KNLKGIEQSSYYSQTICSSKTCIK

SEQ ID NO: 2619 - protein, 24 aa, Homo sapiens
NRSRKKKKAKNGCKQDNSLYRGLL

SEQ ID NO: 2620 - protein, 102 aa, Homo sapiens
DSWGTWCPSRRTGSTPRCGSSSPQPASRTCTSTPGRRRSRARSWSTRCCCLEHSSRGRKAGAGRLRRDSSWWTSAAKPCSRTRIPAKSWVRRSWGLWYRTPK

SEQ ID NO: 2621 - protein, 166 aa, Homo sapiens
PPLLPAPGGEPGSGPPAVSHFCHLLVEPSEHQPAQCRQLHLLLPQSSPHGRSQCLGGHVRAQKGPPAAQPVPEASPEGLKEALGCPRQPAVAEPGVETDLCEIHGGHGVLRGGPDQRHGVEAPAHSRPPGPAHPLPAGGGAERDHGVLGAAASNTLPEDERPERGG

SEQ ID NO: 2622 - protein, 113 aa, Homo sapiens
PAWRTASICRRHCTWRSPITIRMWCLSSWSRKPMLFMPPTTCRSFRTSASKIPETRLCWAWHYGLACTRSQPSCWALEPPSMTPCRMGRRYCTWPYSGRTARAHSSCWSTRQI

SEQ ID NO: 2623 - protein, 80 aa, Homo sapiens
LMPYAPEELTCLCQMRRGTPRCGLHWQTIWRTSHPLWSDMAVMPHAGVRDLVGAFRRSCTEPLMKTTSPPPAFLFAVAVT

SEQ ID NO: 2624 - protein, 92 aa, Homo sapiens
RHVLPGDTAEDQPSACRDPAGNPGGTDQHRHGLGLEPCLFGGQWEVALQEGPQQEGQVTFRATDIPETVLPDTVRVCWDLQLNVRVGPNKYK

SEQ ID NO: 2625 - protein, 104 aa, Homo sapiens
NLVSEPQSKGEENQQEEVAAATAAAATTAASAATTASPASARSSEKCPRALESGVFPASLSVWLCPWGSGANWGGAKPHRHPVTHRVLQRQSNSRLSHEERGLC

SEQ ID NO: 2626 - protein, 210 aa, Homo sapiens
LRAPLWRPQPGAAELRQPPAVPGLRRLPRGGRSCSGSELGQRAVPGAILAGSVWRPTPGGLEWLRARRRRGRRQRRGSRPQRWLPGRSHGLQQPRRLPSAPPPASPPAPPGRRAFLRFWAAANAQPRPSWARRHRCRRAAVSRRPAAEPVRVDAEAGAAVPRQPSENQDERQISSGVHGPPAAGAGEGVSLQSLHHHPEESRASRHAGAL

SEQ ID NO: 2627 - protein, 45 aa, Homo sapiens
MARPQRTIFMIRMPKNQLFKRRIARCKRVHIQQFLLESTEKSTKI

SEQ ID NO: 2628 - protein, 61 aa, Homo sapiens
RRVRGPARAWGGSSGSCSPPQRAHGVQTARGHLGRGGDGDPDAAAGGRAEQPKGGVGPVSG

SEQ ID NO: 2629 - protein, 146 aa, Homo sapiens
QRQEKKASPRSLQGRGTGMGRRAWQPMIPAGRTLGSPSPSLCLSSSRCCQTCSQHEGLHSRQKVQSHHRLRPAALPGKTGENGMLRRWSLTWGVPGRNAGRPLPPPATCCWIVPLSLSTCPRKRPSSSVQRSSSCQEPVIPVFHLG

SEQ ID NO: 2630 - protein, 84 aa, Homo sapiens
ELWTQPFFWQAADGDGSSHCSRDIESHCRENRFLSEGGSCALESAEQRDPGASRHLRRIVLPAALPGPYGQHLRGHHLPCPPGP

SEQ ID NO: 2631 - protein, 46 aa, Homo sapiens
RAPLRARARSHPSCWVSCDGSGPTQGHRPASAAPASTTWRTTRPTT

SEQ ID NO: 2632 - protein, 71 aa, Homo sapiens
LYPHCRGHPALPGHDHGHCGEQVHLQGAHLQDGGRGGAEVRAQKVDPLLRGRHSHHLLCGAQRLRPETLRG

SEQ ID NO: 2633 - protein, 51 aa, Homo sapiens
LVYTVQPVHQVGKEQTNIQTHKLQKHIKSLFRKQPLKMILSFSYTFLSKDK

SEQ ID NO: 2634 - protein, 108 aa, Homo sapiens
QYLKSLLCATDLVKLNQLGFKGHISLNTQAQHYITYVGKSQLLETLTVEHKTWKSVKCFHWQLAITPREFWEEMPHRSLAQQKEIVCPLQWRLEMLRMNMPERKSWHR

SEQ ID NO: 2635 - protein, 37 aa, Homo sapiens
KTWCTGLPSSCPSRRSTPGSSWQDTQGVSRQLPMAGS

SEQ ID NO: 2636 - protein, 66 aa, Homo sapiens
ALRRPEVGPPWAGGVGSSPTEWREGPQRWACLGAAPQHSRGPGMWRREFLLAECWSLCPVGTLRKI

SEQ ID NO: 2637 - protein, 151 aa, Homo sapiens
TAGRMKWSLGGNPPSVVEVARSWATSWTSMTRKSWTGMRSISSPSPPGSARSVTFMKATSMSSVPGLPTGQVLASCRHPAACLSAKSGQCPSQAPRTMYGHPRCGPHPWCCSGNPHCIWGLGLSQAITSVSRRKALSSGSRSPQAPSLAPT

SEQ ID NO: 2638 - protein, 71 aa, Homo sapiens
LCRTAWEVRGTPGPPRPWRFTGWSTGRRRSRRRSGSTACAWAPLCGGGPSAAAKKSMSSAPRTTPWQQPWL

SEQ ID NO: 2639 - protein, 60 aa, Homo sapiens
RKKCKEIKTTSFWSISSGPWGMKFRLQLPIDWDILNRQFMNSACHQSPTLLKLEWWRKND

SEQ ID NO: 2640 - protein, 69 aa, Homo sapiens
RKKCKEIKTTSFWSISSGPWGMKFRLQLPIDWDILNRQFMNSACHQSPTLLKINAVKRIKAKMEASRGS

SEQ ID NO: 2641 - protein, 65 aa, Homo sapiens
YSLKMKLHMRMVKSHSYVMRKGSLFQKSLGKELWMASRSLKAIRAWTAVSKSKGSMEAHHCILKM

SEQ ID NO: 2642 - protein, 63 aa, Homo sapiens
RKKCKEIKTTSFWSISSGPWGMKFRLQLPIDWDILNRQFMNSACHQSPTLLKTRCLMVLGLEQ

SEQ ID NO: 2643 - protein, 61 aa, Homo sapiens
QTITCRFSTSIKVMKVYTDVKEEWRPGEKLTSVISLLLLMCRQQSQCLRNLLMPQQREEKK

SEQ ID NO: 2644 - protein, 57 aa, Homo sapiens
VQKPPSHPQSKKRSCCAFRKMWKRAKCKQSPPLWKQSRSLGLLLPAGLVFGRVDFQL

SEQ ID NO: 2645 - protein, 41 aa, Homo sapiens
TRMKEYILLELKVAASRSIPPAKQLTWGAPARNPTRHLFMI

SEQ ID NO: 2646 - protein, 49 aa, Homo sapiens
KTIPGSVSPAAPLATTTPTRSAAGSVPPTVSPALGAMVTNACPANMDTF

SEQ ID NO: 2647 - protein, 106 aa, Homo sapiens
RGYASIAQRCVRTASMRKHAKSARLSSSCTMICATSPVPVASMQTRATVSPAIKTVWSAVAPKPTTASSVLRVPGSSMMDCAWRSVQQEPIMKRRLRSAEIATSPA

SEQ ID NO: 2648 - protein, 180 aa, Homo sapiens
MGMTWTQCLVMMQATRTSMGLAVLEKWQPLQTIRTAQSELLSTPRSEECECWTEMSRTWLKQNQLASTPSTCTFTAPAGARMMMARLWTDQPPSPGKPLKTALEWGGEASALCLFGHLEMVEGAKTTAPVMATPTASTPSPSAALQKAERNLGTWKSVHPRWPQPTAAGSPTIRKSSLQI

SEQ ID NO: 2649 - protein, 27 aa, Homo sapiens
CPLSASSCCSSLPWGGPWATGPSVPSW

SEQ ID NO: 2650 - protein, 78 aa, Homo sapiens
TMRPAAWWPAAASGRASASSCVWTTSSSWVSRTTARSTTCRGPRSPTPWLVSLWSRARGPASCLWALLSTASRSTSPP

SEQ ID NO: 2651 - protein, 46 aa, Homo sapiens
KTNKKAQKRQKGKKEKKERKRESRPGGTGRATILFVTQTQDSKGKG

SEQ ID NO: 2652 - protein, 66 aa, Homo sapiens
PDNSRRRAVGLVPPHQVCLRALKMKNQQKSTKKTKRKKRKKRKKKRKPTGRYRQSNHPLRHPDARQ

SEQ ID NO: 2653 - protein, 58 aa, Homo sapiens
STKNNITPSWKIKTWTLRIKTLTSQLNLKESVNLTNQLLWREKSSRTIYWKNPHLLHT

SEQ ID NO: 2654 - protein, 29 aa, Homo sapiens
HLLSTSGGFYIFYWNSSEGKWPRHHFREP

SEQ ID NO: 2655 - protein, 82 aa, Homo sapiens
SPAPWMPSGRRLASGPRSVRQAGGAWPSRVPSSTTPQLSPSLAPSCPLETEPWSLRRPCCHGSLKKTRVPTKVLRPQRALGL

SEQ ID NO: 2656 - protein, 52 aa, Homo sapiens
VVTGSTVLTSYLLLQSVFWVRVERWMPFEYRWKSDSWHQTPPKSLMSPLRPR

SEQ ID NO: 2657 - protein, 32 aa, Homo sapiens
VTLQTGQRMWSIPLQEFILLNHLLKYLQGAFV

SEQ ID NO: 2658 - protein, 17 aa, Homo sapiens
SLPNFLILQMPWILLFS

SEQ ID NO: 2659 - protein, 29 aa, Homo sapiens
RRRRYCQSLEVRPPRWPLRPWLNCFMGPC

SEQ ID NO: 2660 - protein, 70 aa, Homo sapiens
TRGFPRMATRRCTSTTTRRASLCASSAMRALSLSARSPSPVCPATPPSGPASPHSAKLPMRSSWTTENWK

SEQ ID NO: 2661 - protein, 66 aa, Homo sapiens
RTCTLGALPPFTVIRATSCRERRPSSASMAPGHPGTVKPPAAWHPVVAPSTMPPWAASCPQSLGEP

SEQ ID NO: 2662 - protein, 54 aa, Homo sapiens
QSPHPREDGDSGGQGFYPRELHHPRGDPDCGQTLHSREGLFSGRVPCPRSPTYG

SEQ ID NO: 2663 - protein, 40 aa, Homo sapiens
KEPLPKKHVLSSRLQTPKRRSRSPRWSRKTTRKTRMKELM

SEQ ID NO: 2664 - protein, 35 aa, Homo sapiens
RGGAPQRAEASERGGAPQRGSGFQRGGDPERGIAP

SEQ ID NO: 2665 - protein, 153 aa, Homo sapiens
TPGAGAARGEGWGFRALHLPSGEQAWLPAASPGPLCAVSSREPESDGFPSKQDSPGKPWERHVSPSTGGPKPVPGLCHTQQPPSQAELDPEGTGSEPLPALRPRGPGAASGSSGARRRVHLPRSAPTGLPARLSQPLRALLPEAAGPLLLLGG

SEQ ID NO: 2666 - protein, 140 aa, Homo sapiens
TPGAGAARGEGWGFRALHLPSGEQAWLPAASPGPLCAVSSREPESDGFPSKQDSPGKPWERHVSPSTGGPKPVPGLCHTQQPPSQAELDPEGTGSEPLPALRPRGPGAASGSSGARRRVHLPRSAPTGLPARLSQPLRAL

SEQ ID NO: 2667 - protein, 107 aa, Homo sapiens
APPSPQTPGSWSCLGFKWSTKESSPATLGTHWAPSTSLSASPCTTPRSCWAPPAPGRLRVCTAAAPPRPARPPLCAGGLGRSCWRGTAARTPSRSPPAQPGPGPTAP

SEQ ID NO: 2668 - protein, 106 aa, Homo sapiens
QHARSSREPESDGFPSKQDSPGKPWERHVSPSTGGPKPVPGLCHTQQPPSQAELDPEGTGSEPLPALRPRGPGAASGSSGARRRVHLPRSAPTGLPARLSQPLRAL

SEQ ID NO: 2669 - protein, 36 aa, Homo sapiens
DWTIPELCRKKHFSIPKNVDSAVWICFGSWMCSSYH

SEQ ID NO: 2670 - protein, 21 aa, Homo sapiens
KKKGELSLEPWIPYLHQQKTQ

SEQ ID NO: 2671 - protein, 103 aa, Homo sapiens
AAYPPATSCCPPTRCRGQAWRRRQRGQWVSRDGTGVPVHPPRPSRACPPSTSPTLTCCTLRTAAGQPRPLGPAVGRSHLRSLSSARSLTAKPQRAAWTWCPAG

SEQ ID NO: 2672 - protein, 102 aa, Homo sapiens
PWRSTRWSRCSPWWWAKCSRTSRRPASCSTSPQIPWTGAPAMCRSGSCGQSTNTGCPPWARPSRSWRARSCAPCRRSSSASARPWVGMCCTPTWTSGSQRPG

SEQ ID NO: 2673 - protein, 84 aa, Homo sapiens
KSGLHLGRFTTVPRPVRRAGPTARWTHHAPGSPSTCGSSSRSCYSSPTAMAASLGGSTRRRASSKLRTQPRWPGCGASARTVPP

SEQ ID NO: 2674 - protein, 171 aa, Homo sapiens
PWRSTRWSRCSPWWWAKCSRTSRRPASCSTSPQIPWTGAPAMCRSGSCGQSTNTGCPPWARPSRSWRARSCAPCRRSSSASARPWVGMCCTPTWTSGSQPRPVRRAGPTARWTHHAPGSPSTCGSSSRSCYSSPTAMAASLGGSTRRRASSKLRTQPRWPGCGASARTVPP

SEQ ID NO: 2675 - protein, 187 aa, Homo sapiens
NQIRKKKKEGIQDQDHVLGGGGLPHLLDTGGQEADRDGGHILSLGVGDDPKAQGGEDLIPEKEVEGQGAHQKQETKRKKTKKRNVLKHHQKVTAQPDVLEVQAVCTFVILERDDDEEAGVAQDLLKSLGLLKENCPAHHPLGDIKRRRRKIKTKKEVGMKENDQQARRRRVKIRKRTGKENQRVIKM

SEQ ID NO: 2676 - protein, 180 aa, Homo sapiens
NQIRKKKKEGIQDQDHVLGGGGLPHLLDTGGQEADRDGGHILSLGVGDDPKAQGGEDLIPEKEVEGQGAHQKQETKRKKTKKRNVLKHHQKVTAQPDVLEVQAERDDDEEAGVAQDLLKSLGLLKENCPAHHPLGDIKRRRRKIKTKKEVGMKENDQQARRRRVKIRKRTGKENQRVIKM

SEQ ID NO: 2677 - protein, 48 aa, Homo sapiens
KPQHPHWCCPQKSWPCPCSALPQPPGSQPCCHLCCQCFRKNCLRRKRR

SEQ ID NO: 2678 - protein, 126 aa, Homo sapiens
LHEPVLSESQILSNFLLDRNLKETFLLALREFQARSVLLPKLPLPRTISQSQDPLLCLFPVEPQVPITHGQWMPPLMRLYVKQNWEHLQICPPTFLISLLRQCLLPLPNLSTRCMRRKPSCLPPWR

SEQ ID NO: 2679 - protein, 60 aa, Homo sapiens
IKGSPKVQWTNISSSKNPHTRCTSPKQTIYQKLMCSHCVALDFIFNKEQIPKLKNLCPQC

SEQ ID NO: 2680 - protein, 49 aa, Homo sapiens
MVLTSSKAQCSLRIPFLPLPHHHHHHNCFFLPLLLFHRFLSFLQKEKAL

SEQ ID NO: 2681 - protein, 37 aa, Homo sapiens
PPNNTLEIPTCLGGSQGKLTPRKQHSWSTSHKCTKLK

SEQ ID NO: 2682 - protein, 27 aa, Homo sapiens
TPPWQGHCEWTKISGSKFKKKWCKSSW

SEQ ID NO: 2683 - protein, 73 aa, Homo sapiens
ARKSTCCCRPALYSPAFQRHLTSTLQKTPDRGSKFNIFHVYATAGARKKLPAGCAERVDQDSYQRATLFKCIW

SEQ ID NO: 2684 - protein, 155 aa, Homo sapiens
GRTRAVKISCGMLRLQIKMWLKYHLLFLQNQNRLICLILDKLISHLQTLSQTEVLSSCQQLFRPWELNQNQQGSSRECCYLPAYLRLAKTRPFLQVLSKKVHLLLPSGPLLPSLPKTPYFHPSENPRPWQQVQYIPCIRNSRRQEKTSSRLCRAR

SEQ ID NO: 2685 - protein, 37 aa, Homo sapiens
SLLENSWKMGAPCLTTTSRKSPPCTWCSVSEVGCKSS

SEQ ID NO: 2686 - protein, 37 aa, Homo sapiens
SLLGNSWKMDAPCLTTTSRKSPPCTWCSVSEVGCKSS

SEQ ID NO: 2687 - protein, 37 aa, Homo sapiens
SLPENSWKMVVPCLTTTSRKSPPCTWCSVSEVGCRSS

SEQ ID NO: 2688 - protein, 37 aa, Homo sapiens
SLPESSWKMGAPCLTTTSRKSLPCTWCSVSEVGCRSS

SEQ ID NO: 2689 - protein, 34 aa, Homo sapiens
LVRPSPSRLSPVTPSRMSRQRSKIRKASLLTSRG

SEQ ID NO: 2690 - protein, 34 aa, Homo sapiens
LVRPSPSRWSPVTPSRMSRQRSKIRKAFLLISRG

SEQ ID NO: 2691 - protein, 34 aa, Homo sapiens
LVRPSPSRWSPVTPSRMSRQRSKIRKASLLISRG

SEQ ID NO: 2692 - protein, 28 aa, Homo sapiens
LQHPERVHLAPGAPSQRWDADLREDPDW

SEQ ID NO: 2693 - protein, 28 aa, Homo sapiens
LQHPERVYPAPGAPSQRWDADLREDPDW

SEQ ID NO: 2694 - protein, 12 aa, Homo sapiens
RWDADLREDPDW

SEQ ID NO: 2695 - protein, 30 aa, Homo sapiens
CLIKEKTAIFFSIPHVPKATAAHSVTVKLQ

SEQ ID NO: 2696 - protein, 85 aa, Homo sapiens
DHEREAHAETAGEGKISLDTSSGRCSLLQYPSGRETSAHCCARNHTAPDQAASHKVIPEGGGRNLRDWRLIIECEMCSTDLGKKG

SEQ ID NO: 2697 - protein, 72 aa, Homo sapiens
KKFFLKEPVRNVENCKLNSRQKDLQKLMILLQEQEAPPLSVSKPSLRSWLKKNIGSRKQRDKKAKRIQLASS

SEQ ID NO: 2698 - protein, 52 aa, Homo sapiens
FQFTRKTTPISVTCVIKAFTGLQNSRNTWLPTRAKKCTSVDIVTLRLQIHLF

SEQ ID NO: 2699 - protein, 34 aa, Homo sapiens
PWTQSRKLILVKWMALALRSSRCTFLKLTLEKMT

SEQ ID NO: 2700 - protein, 55 aa, Homo sapiens
RSRSLLLLSASTPCGSAAPSWPRCPPSSRCGSASRSMTSPAPPSSTANASRRTMT

SEQ ID NO: 2701 - protein, 31 aa, Homo sapiens
AACGSRGAPRAADRGPPEPQGQPREDDPDHV

SEQ ID NO: 2702 - protein, 44 aa, Homo sapiens
GLGTLQVLFPLFSSRPRVPSTVCKETWWYPPSGHLPLAMGCSAA

SEQ ID NO: 2703 - protein, 62 aa, Homo sapiens
PSGWGQGWWTQPRLSPRTTASSQWSCSCPPRLQPWPTWTGGAPHLPGRHWPSSSLVDNPNPM

SEQ ID NO: 2704 - protein, 45 aa, Homo sapiens
LGEENRTRKKWLRVDLGMWMMLGTVLGPGIMTGLMMMMTAMRARV

SEQ ID NO: 2705 - protein, 32 aa, Homo sapiens
LLLMSISTCLLIPFLTFFVYFQREMKKPNFRF

SEQ ID NO: 2706 - protein, 49 aa, Homo sapiens
SRCRWRSSAGGSSPSPFQTSNCSLEISGMMRPWVTPWCSSGGSGATSTV

SEQ ID NO: 2707 - protein, 111 aa, Homo sapiens
QGSKPLKRFSGLLSAWAKASGFLSAKALWFRLWSCPSTPWPAARPMCSSRKTLQMSGKKRCCPHTLKPSMTCCLPSGQFVTALGTMGAALATSSVCLTGRWIPRDVCALRS

SEQ ID NO: 2708 - protein, 57 aa, Homo sapiens
FPGSTPTPSVQQTTQGCTSSHPTPPSMTHIASMLQLHLKKIVHQSQTCPMPLMDQLP

SEQ ID NO: 2709 - protein, 51 aa, Homo sapiens
AAAPPVKGAALQEVTSFTPFLLYTPSQTKTVPGSPTAQTESLLPIWTPVIV

SEQ ID NO: 2710 - protein, 45 aa, Homo sapiens
AAAPPVKGAALQEVTSFTPFLLYTPSQTKTVPGSPTAQTESLLPL

SEQ ID NO: 2711 - protein, 122 aa, Homo sapiens
AAAPPVKGAALQEVTSFTPFLLYTPSQTKTVPGSPTAQTESLLPVRLQIPSQQAGSQMKKMKMKETDTSVFLDQALMMMKILSPAPFQPHHGLLTTQNRTRTGPSGTQAIQIRKCYFRQPQG

SEQ ID NO: 2712 - protein, 118 aa, Homo sapiens
ALVLQQLRQQPRGKKPGIGFHGCFYHQSQRIIFTQQHKWLVRLQIPSQQAGSQMKKMKMKETDTSVFLDQALMMMKILSPAPFQPHHGLLTTQNRTRTGPSGTQAIQIRKCYFRQPQG

SEQ ID NO: 2713 - protein, 84 aa, Homo sapiens
AAAPPVKGAALQEVTSFTPFLLYTPSQTKTVPGSPTAQTESLLPIGMMSQVEEETQIILKAQLLYWKVIPLITHTRRKAGPSSQ

SEQ ID NO: 2714 - protein, 82 aa, Homo sapiens
AAAPPVKGAALQEVTSFTPFLLYTPSQTKTVPGSPTAQTESLLPETKTHSTPVGGPIPLMDLNQMDTHMGVKKVEQTQPLVL

SEQ ID NO: 2715 - protein, 61 aa, Homo sapiens
AAAPPVKGAALQEVTSFTPFLLYTPSQTKTVPGSPTAQTESLLPDTHMGVKKVEQTQPLVL

SEQ ID NO: 2716 - protein, 22 aa, Homo sapiens
TPERSYLQALFLPDALGCAVPS

SEQ ID NO: 2717 - protein, 72 aa, Homo sapiens
RQCPLRNSILFLRTKNLRTKNLRSLPLPPGLDYGPFRMDLPILRQSLAMLPNLILNSCCHLILLPQPPKVLG

SEQ ID NO: 2718 - protein, 114 aa, Homo sapiens
DKEQTAGSWTDQPIASCVLCHLLCCSGSCHSDLGGESTHRSPGALQHFPVYLLLHTTEKDQHCQHMGRSCGWGHPACHGLDSGHGQPRCWRISPGRNPLLLAVSSFQRPELGPP

SEQ ID NO: 2719 - protein, 12 aa, Homo sapiens
KNIFRSSQSRNI

SEQ ID NO: 2720 - protein, 128 aa, Homo sapiens
AQGSPLPRLSPPSGGQDVFALVLSSQVAIPMLCMCGTHCSRGCECGCWMIMRRSVPGMRASFGRATTVCLLCRYFGSQQAAPIGCTGTCWRSWALRKTLRTWLRLMSTKGQWPVESWVEPCLPGAGGP

SEQ ID NO: 2721 - protein, 76 aa, Homo sapiens
SWRIQRRKYRWALGPVARSTRARRKRKLGQQQWWMWRRERRKRRRMRTSTMKGQCQKCLCLSCPDTPGLLPQSATH

SEQ ID NO: 2722 - protein, 92 aa, Homo sapiens
RRACGCIPQSRSSPAMSPRTLCSQTAGSSPKALSASSVFSEPITTQLCGRTLRSTTPFALTQRTSRRGHLWLLFPSRQGPGTASGRRSRWRR

SEQ ID NO: 2723 - protein, 26 aa, Homo sapiens
RNIQRKKLYHPKKTLIGTCPKSLLCH

SEQ ID NO: 2724 - protein, 23 aa, Homo sapiens
FQSTSIKRIMVSHLNTYVSETRK

SEQ ID NO: 2725 - protein, 21 aa, Homo sapiens
LEVAPQKKTLIGTCPKSLLCH

SEQ ID NO: 2726 - protein, 92 aa, Homo sapiens
SGKAETWTSSSQLLKYFGPCFPWAASASSHTAASTRRPIGATSWGSARTCRSPPTCSPQSLLSSWRSTQPHVPPSTLWGVRMTSLSASTSLW

SEQ ID NO: 2727 - protein, 32 aa, Homo sapiens
IPFCPRLRLFCCWGGFLPPVSWPRASACVPSP

SEQ ID NO: 2728 - protein, 93 aa, Homo sapiens
TLREARAAKPPAAGPPPWIAAASCSGAAVKPPRRNHLCCQLHPKVPLQRALSATLPSGQAALALETVKKPICGPPSVHEAVQMPAVSAPGCPP

SEQ ID NO: 2729 - protein, 116 aa, Homo sapiens
KSVRWMSQTPRAAAPQAPDPAHPTTAPGASARRTVSRPPSPASRRRRVWRTDLWHEKARPLHFPSTHRHPCPTSRWACLPPAPLRARRASRTPRDSPFPPSSRGSPFSPAPTSLPT

SEQ ID NO: 2730 - protein, 76 aa, Homo sapiens
SSPRKGFTAKTQCKRCPFHGESHGDPQQVLALPAAHNLHSGAFSDRGSDLRERRSRDGHRHGLAVRGREARRKETR

SEQ ID NO: 2731 - protein, 202 aa, Homo sapiens
AGGLRRGLRARPGRTAQPEHAAQRHVGGAAGQRGRHGGSRGSLGGRGQRQRRLQRQPAQRAAGLRKPQQLQPRRAEQRRRGALLRRGRPGLSRATPAAAAAAAPPAPADARAAPAAAGPEGGASDSARDARRDTAPVPHRHGVPGADQGGEEAHEEPHRCLQVPKKEAGENRPAGGKSENLESSELGAGVHGQHAQGTGGTA

SEQ ID NO: 2732 - protein, 75 aa, Homo sapiens
PQDPETEHDPEPGRPSGEPEAAPPRQELGPPHLARRGAAQAGVARAGAPDNPVQQRAHHHHADPHPVPVPQERDR

SEQ ID NO: 2733 - protein, 51 aa, Homo sapiens
AAENYWKRRLSQKTLEDEFYNFRKSLQLGRLAHETSTNKFSSGQLRRKTGI

SEQ ID NO: 2734 - protein, 25 aa, Homo sapiens
YRGRSTFSCVPPHNLPRDRCQKPLL

SEQ ID NO: 2735 - protein, 184 aa, Homo sapiens
VPRASRQASVQQPSYLSSSSSSNSSNSNSSSSSNSNSSSSSSSTTSGSSSSSRSCGSSSNSNSSSSSSSNSNSSSSNSNNSNTSSNSSNRRLLPNPSPSPSPSSSARGFSRPSSSNRQQLWSGNFNNSSLIPSHSPVPTYLDATEPPGGTACALDVAPPFPLNSQSHSWASTSSGWGPPLRLHF

SEQ ID NO: 2736 - protein, 31 aa, Homo sapiens
TKKSSKESPDRRREKKCRKRKAAEKSEKEEG

SEQ ID NO: 2737 - protein, 25 aa, Homo sapiens
EVQKKNLFQRNWPRLKLHWKKLLNF

SEQ ID NO: 2738 - protein, 68 aa, Homo sapiens
RCPRWPPTSIPPSTGAMGRPRAAWSASSSPATCWAASSSSPASASTATWASCTPSSPEATCDPSTPGP

SEQ ID NO: 2739 - protein, 156 aa, Homo sapiens
PGAGGVGLRPAAAAHAGSLRRPRAGRATQPRHDCGREAACGSVGGQWCGPLRQLLCALPHHAGAQRGCSAALEHPLPELCRHSPGHSSPGAGALRGLPGDAGPHAPGLLCPPSTLHGRSAQPGLLLPTLPRLQGQLEPRGRQEHWPSPAPQCHSRP

SEQ ID NO: 2740 - protein, 80 aa, Homo sapiens
SPRKGQRTAGQCLGHSVGALRSRAEPTQPSRLRGHQLLVPVWPRTSRRSTGCPRHPAGVVPAHEPVRVQGWRQLRDGSCP

SEQ ID NO: 2741 - protein, 160 aa, Homo sapiens
RQRVPGLPTWRAARPPPRSDPHCCVAQPQVRSRGARPRTPCLKFRPYLSPWTGYSSLGPARDRTPPTKRRRTSSRCRTWRAHIPELKLQGVLEAAVLVPQKRTADCWTVSWTLCWRPQVPGRANPALPPARSPALGACLAPNFPKIHRLPPPPSGCCPRS

SEQ ID NO: 2742 - protein, 31 aa, Homo sapiens
CWRTNHPERAGLQAGERRPYRASRHLWAHPG

SEQ ID NO: 2743 - protein, 88 aa, Homo sapiens
GKGLIFSSRGYRNQLSLTAVLDHVMCQSSLVAKIYRMSTSHCASSSGLSPASFLASSPASERTMMSVCCRPSQLRSSSQWWLALMLEN

SEQ ID NO: 2744 - protein, 92 aa, Homo sapiens
VTTYPSLMPKQPSPCPPSMGSTTSALKSSPRTFFMWTSPSSVYASAQGTSTFSRELLSPRISRCWERYAFEDIWMHSGSWKRRASATGPSQA

SEQ ID NO: 2745 - protein, 72 aa, Homo sapiens
DNVLCNAALYPACGICHCDCPETGDMASRYARRCPVVAVGDLTGVHSSADVSAPRLQVPNASEQPTGLPMHT

SEQ ID NO: 2746 - protein, 136 aa, Homo sapiens
IVTGPKHQWAFQAPMGLSRLLRPLAPMVPQQPTGPNLLPPWQLLTALSHQPHWLLPMLPSSIPRLLPPTAASQAMPTMGQVSRLQPTCPCPRGPLPTPTAPRRPMSVPASPHPGPATTIPTKRLSPCRKGMVPTGV

SEQ ID NO: 2747 - protein, 103 aa, Homo sapiens
LRGPSINGPFRLLWGSVGCCGHWLLWCRSSLRGPTFCHPGSSLPHSVISLIGCFLCCPAASPGCCLLPRPARQCLRWGRSAVCSLPVHVPGGRCQRQQHPAAL

SEQ ID NO: 2748 - protein, 21 aa, Homo sapiens
SGWQTRKRASPFYGKGVPSST

SEQ ID NO: 2749 - protein, 61 aa, Homo sapiens [sequence omitted]

SEQ ID NO: 2750 - protein, 227 aa, Homo sapiens
VVSPATWPVPSSCHTEQRWVLLAPSSASWPASSWSSSRAGRSWRGPGVPSSSCWLWCSSSSPLGCCRGLTTLPTSQGSSVASSSPSPSCPTSALASSTCTGNAARSSSFRWSSWASWLAWWSSSTSILSAVSGVSSSPASPSLTSSVRSTNWTLSSTELAAGSSGRVLQQARARHDLPEPHRLTGVTCSMWGLACFLNTDLFLVPCSLLLNPSYCRAFIILLPVITF

SEQ ID NO: 2751 - protein, 91 aa, Homo sapiens
SGPSIPAPQSLRATRDSLALSATRIPGCVMSPPPKTLMSGQKTSPSGRSAPKTALGTTPTIPTWTVSSQDGPAALAPRAGVRSPPGSTVTS

SEQ ID NO: 2752 - protein, 17 aa, Homo sapiens
WHAAPQPPGPCLLHLPT

SEQ ID NO: 2753 - protein, 67 aa, Homo sapiens
RNRAHWVREPWLPCPCLVACCPPATRTLPSPSSHLMPLSYLRTRRRQASHLSVEVQQRLSMTAQSQR

SEQ ID NO: 2754 - protein, 24 aa, Homo sapiens
CNNSRKKIWQDSRNIWKIGGLRSH

SEQ ID NO: 2755 - protein, 18 aa, Homo sapiens
FKKKNLAGFQEYMEDWGT

SEQ ID NO: 2756 - protein, 59 aa, Homo sapiens
GKRCLRKDLQRNADLLPELTSVRKKNWILVNLFSGTSKAPFLCGGIDQTSQPSAGPRGT

SEQ ID NO: 2757 - protein, 41 aa, Homo sapiens
LKFLWSCSFLVLPKSINFGDYTFLLIKKLPSLIRAQPFWGA

SEQ ID NO: 2758 - protein, 119 aa, Homo sapiens
NIDPHQSNFPQAQEIVPQVTILHHNRQAAFSNLQLLLLLLSHQVFLGNHLWISIKLACFLQLPYHLPAHHKDLELLSHLLLHQPLHRPHTLLMLRAQLLVPLQPPLLPKIQASPLSPLC

SEQ ID NO: 2759 - protein, 89 aa, Homo sapiens
NIDPHQSNFPQAQEIVPQVTILHHNRQAAFSNLQLLLLLLSHQVFLGNHLWISIKLACFLQLPYHLPAHHKEPRPPRSWQTLLDLTSSM

SEQ ID NO: 2760 - protein, 14 aa, Homo sapiens
FLTKKKGKKSRSAL

SEQ ID NO: 2761 - protein, 107 aa, Homo sapiens
SWVCFSWRSTACPMARSPMTHSMLSSLSSPSPRLWTSSSLFRKTAMWWASWSSTPRRESHTCAQRTESSSATGMALFTTSSTWPWPAPSAEGRDTGILDSTGWVPSP

SEQ ID NO: 2762 - protein, 99 aa, Homo sapiens
CTCFMSCLSAAWLPMLSPSLVAPGFQTGPWCLLEASARHSSRTWGLPCTCAHPSPTVCLRTPGAASSCAICCMRWAPTCWPTVAFSGPHSSTSHHPPTP

SEQ ID NO: 2763 - protein, 45 aa, Homo sapiens
GLMILLCQILVCTTMENPSLIRKQLRIFRKKIICIHIELLFLPLP

SEQ ID NO: 2764 - protein, 78 aa, Homo sapiens
GRHQRELQKLPLKVFKKSTCHSLVLAIPQVLFRNLRMMVVLLVIDSLLINKYIHTLQMAVIGKPKAEWPGRLMLPRQC

SEQ ID NO: 2765 - protein, 134 aa, Homo sapiens
RVLSVYISKLILERSHTNAMNVIKPSGRRHASYNISDFTQERLPLHVLNVENSLCAKMILLHIREFTQERNRTNAVTAGKPSLQNQGSMFIKENIQERGPMDVVIVGKLLRTCLSLLNTGEFTGSHFGKASCQM

SEQ ID NO: 2766 - protein, 125 aa, Homo sapiens
NIMNALNVTKPSSRNHSSIYIRKLIWEGNLTHVANVGKPSSRSVGSFIINELIQERNPMDAVYVGRPSLQSSVSLHIRKLIQEKNLIYVVNVEKASLRRGVLLHIIELILVRNPLYAINVGKASP

SEQ ID NO: 2767 - protein, 61 aa, Homo sapiens
KRPMNTGSIKVEERKKEKSYVSIIIWRKPKNQKLAAKWKQRIVTLKMLGNIYWNQFQKSSI

SEQ ID NO: 2768 - protein, 33 aa, Homo sapiens
KYYPKILIMKKMKSQKRERMSRRTQQINLQNHK

SEQ ID NO: 2769 - protein, 22 aa, Homo sapiens
KTSKQQGQRSKRCLVKYSGTVA

SEQ ID NO: 2770 - protein, 21 aa, Homo sapiens
CLAKIVTDAGTGFFPNVGGFL

SEQ ID NO: 2771 - protein, 82 aa, Homo sapiens
WNNSEEQIQTFPVVKILKIQMRMKRKMMKKKMRKMMKMMNLMTANQNQIVIQNQIQKDQKKKMMMIKTKMNQIVILKERKLQ

SEQ ID NO: 2772 - protein, 115 aa, Homo sapiens
RGSRGPRPTSWCFQKEETHLLLQNRWSMLFGLTRREEAHCPWKRQILRWRGGWRRLPRAAFRPPSLHGTRTWRCIVWSKPPPRTPVIKYIIGASLWDLTKGSLLKETHTCLKPIR

SEQ ID NO: 2773 - protein, 24 aa, Homo sapiens
NMRIQYLLNLWGQAVIQKMLFLLE

SEQ ID NO: 2774 - protein, 71 aa, Homo sapiens
NSLKPLRSQCSSVRRNTWIWKPLSFSGTRKLVIGKQLCLPGRMRRNMTHQKSHYHIQLRKLDVKFQQLLHI

SEQ ID NO: 2775 - protein, 53 aa, Homo sapiens
VHGLQGPAPRGTPGTLPERLPRRPLGNRFCGHRNQSVSPVFSGQLAGRTATNT

SEQ ID NO: 2776 - protein, 60 aa, Homo sapiens
RIWGALTASGADLMCGWNSTHPGMWSSPLMWGMGMRTSQYTQTTLSSMMTSGTWSGLKST

SEQ ID NO: 2777 - protein, 191 aa, Homo sapiens
AFWWPFCCWGWWECWCSSICKIIAIRAPTIPMSPRLPTSTILAANLPYPLQALPRSPPLQQLPTKLQPQPQPQPQLQPQPLAPGIRTYPRSWRSPGLNESEGLLGPIPAPDIPPVLPLPHPIRDIWLLLAGSAHPEDIPPSPPHQVWWAELQMGPKGVAEPHCLNQCPSHPCFPRLLAVYLPQRRSLMGLT

SEQ ID NO: 2778 - protein, 46 aa, Homo sapiens
KTHYNPMRLLIYQNPYLDSSILSTWFFPRVVVILLPLMNLMVLLKL

SEQ ID NO: 2779 - protein, 40 aa, Homo sapiens
WAGWAGGAGILRHHLGGAVLLLTTSTRHLPTWKVAAAASL

SEQ ID NO: 2780 - protein, 44 aa, Homo sapiens
AFLAPLESQGSQEAWDRKAPWDHLVSLEQRGNEESGVTCSLKPW

SEQ ID NO: 2781 - protein, 26 aa, Homo sapiens
KKERIQSPESKLWTEEMGVDHLHQKK

SEQ ID NO: 2782 - protein, 44 aa, Homo sapiens
SLCAPCWMMRNITAWSCWPKNSRTRLPPGCRNTWCSSHGGQVTM

SEQ ID NO: 2783 - protein, 13 aa, Homo sapiens
PQTGSTSGSVGRP

SEQ ID NO: 2784 - protein, 120 aa, Homo sapiens
DSAPPSALPSQGSISQDKERRQLPGISDPRQGCGPAAMDRITRWCDGTSCKSHMCECHNPPAGLAQGLQGAGLPLSLPSLLYPVSSGHFLGSAAWGVVACRGHAPPSLPRKLLCPGGHSC

SEQ ID NO: 2785 - protein, 95 aa, Homo sapiens
HGVASFPMTPPLCMRKFPLAPVSDLDTFTCCSHKACGAGFGCPHCQLQDPFPEPHIRVPLPSPPISMIMTLDISARPNPKAGTLLSHFSIAASWL

SEQ ID NO: 2786 - protein, 98 aa, Homo sapiens
RMTVGTDTLRAKGVDLIPLETGKIMTEVTLACLKEILGQKLRMVFTVLQITPMGALEVILCLLVYRPVLGLVIQQGLTRMVMIALSNTEVMFQICTMV

SEQ ID NO: 2787 - protein, 33 aa, Homo sapiens
NWQERSPPLRKQKMAVIHLSGVQKNLRTPFPSK

SEQ ID NO: 2788 - protein, 156 aa, Homo sapiens
SQFWRGLLHCPVTCMATPFVPSSSSHSTSAACSRRAASTCLIALNPKRTGIECTSSRKPLHTGLGLYKINILPLLLTSLLRTSLSISTLQEQCFCSCPTPSASSQGSSGGGGTPPAPPTRTCSARSGSATTGPTTPCSPKHGAPAPQGMKSLLIGC

SEQ ID NO: 2789 - protein, 43 aa, Homo sapiens
ENLIICLRKNFYSGSNTVPHQMLSLQVPCLQWQASSCLHFIPL

SEQ ID NO: 2790 - protein, 20 aa, Homo sapiens
IVGVTCELLCFRRGMVCCEN

SEQ ID NO: 2791 - protein, 56 aa, Homo sapiens
KQTTKTTMGISLNPLPKTWLQPTQDIAIAQFLWETFLLWPPQPTSYSRLRTKFLPT

SEQ ID NO: 2792 - protein, 43 aa, Homo sapiens
KPPRAKEELHYEVQIVQKLQNLPQKKRGMIRLLVCSPRSSFSS

SEQ ID NO: 2793 - protein, 37 aa, Homo sapiens
KPPRAKEELHYEVQIVQKKKRGMIRLLVCSPRSSFSS

SEQ ID NO: 2794 - protein, 31 aa, Homo sapiens
AKDSKTALSHAYAAGASHLKKNSPWRKSSRA

SEQ ID NO: 2795 - protein, 76 aa, Homo sapiens
RHPLRPYGPRVPTPVWRGRWHLRRCLKETGRQDLRHAPSPLPRAKDPSRSRRLSNTSTRLCPALCSCWGSSGTPHF

SEQ ID NO: 2796 - protein, 117 aa, Homo sapiens
PRTVPSSWTSFSSSWRARRQSPSTGPCPPSSLMPEAKHPCHRAVARPAPLSLPWGADPIPSGPQIHHYILGPQSGPSGISAQSSWEQRRWGPLSLHPMSPPSRQGLQRVLGLEAQTC

SEQ ID NO: 2797 - protein, 61 aa, Homo sapiens
DICRCHSLHLPSVPGRTARAGSPHSATPPSTRTTACRQPTRCQAWQAGCSGPHLSPTCCPN

SEQ ID NO: 2798 - protein, 27 aa, Homo sapiens
DCCTNATPWPTSWRRLGEWPPLGRRPC

SEQ ID NO: 2799 - protein, 95 aa, Homo sapiens
WNRRKGVNMWSVLIPLMDLPTSIALCPLEPFLASIERNQLMSLLRRMLCNQAGTWWQPATHCMAVPPCWSLPWTVGSTASCWTRPSGSSFWWTRM

SEQ ID NO: 2800 - protein, 25 aa, Homo sapiens
KITENTYLLLEKLASRGKLIFLMAV

SEQ ID NO: 2801 - protein, 73 aa, Homo sapiens
DRLPHPLTALASWDRHTTWTTLMRKEECTWSWCGSERPKNTLLSTWSFILVSQKSTIGLGLNISSRWQIIVVI

SEQ ID NO: 2802 - protein, 52 aa, Homo sapiens
LWLEKNLRASCKSFPRWRRSCGLLGPIPPPREHELWPAPSLTLSSLRNGQVM

SEQ ID NO: 2803 - protein, 33 aa, Homo sapiens
ITSICQSWAWLSSGAVLLVLPLGMTAQHSRRSG

SEQ ID NO: 2804 - protein, 91 aa, Homo sapiens
RQNPRRPGSPGQQPGPEVPGRPTPQWGCGRRNPTFDEPEAVGSPPDPSPAAAPAPATASAICPSAPAAAAAPTAAISAAPPFPPGTPRRQP

SEQ ID NO: 2805 - protein, 41 aa, Homo sapiens
RRRRPKRLGVRLVRRLVPRCQSSSPRLWPPLKSVAEFLWLL

SEQ ID NO: 2806 - protein, 33 aa, Homo sapiens
CGEKQQPYQTWSQEPGEQGHSGANERHRCFWLL

SEQ ID NO: 2807 - protein, 50 aa, Homo sapiens
FWELQQSVFKFWTHEGRKFWRQKLWPLWRWRPILCKTTKPRWLWRFQQQQ

SEQ ID NO: 2808 - protein, 77 aa, Homo sapiens
AMGNAHGLCGNERSKHQALQGLWVCHICHCGGGGCSYECKATQGGWKSCGTKESCLQRRFSKTRCPLNCEKDICWWH

SEQ ID NO: 2809 - protein, 73 aa, Homo sapiens
CGQPKQYHLCADKGTFWRFHALWLTGCLLHTSCNYDCHLLSHYPCFTEEGLLSQKQATSTPNMVDCVYSFPKG

SEQ ID NO: 2810 - protein, 63 aa, Homo sapiens
LCLQFSKGMKHLARHRKRWQCWMVLERTRLCPTQVMKHLCEEHPQLGKSQCRPFPTNREPQRS

SEQ ID NO: 2811 - protein, 55 aa, Homo sapiens
SSMWSSAGGPSSMWSACYCPASSSWSWTSWASTCPPTVARGSLSRLHSSWATRSS

SEQ ID NO: 2812 - protein, 65 aa, Homo sapiens
LLCRNEVLCGHPPAAPLLCGQPATAQHLPHGHGHRGLLPAPQQWREGLFQDYTPPGLLGLPDHRF

SEQ ID NO: 2813 - protein, 42 aa, Homo sapiens
AYGVEDQWMEWVLHSIRKEKTNHFNFWMPPASMTTHHSSSTM

SEQ ID NO: 2814 - protein, 74 aa, Homo sapiens
SGRSGLDCEPEAQRQTEETRPLPLKSVTKKENQAPLPILLHQPLRESLWNCPFQYNNLLLYKSFPLLSLALRDL

SEQ ID NO: 2815 - protein, 56 aa, Homo sapiens
KSKKCSCQCTQGNMANLQKYKASEKDRSCKSKKTSTKIPASYSSIKKCKNGAEETE

SEQ ID NO: 2816 - protein, 12 aa, Homo sapiens
KMQLPMYSGKHG

SEQ ID NO: 2817 - protein, 31 aa, Homo sapiens
IWICMSSLKSLDPHVRLMLLWPMPWRKSRNF

SEQ ID NO: 2818 - protein, 87 aa, Homo sapiens
TLSWTWGASERPGSCTSSTTCSQGPWCWTTSGGFGTWYTSKGSHHQRCHCDSRRATPTYCEGCSSTKSTDSGHPEDTFASTSCTRNI

SEQ ID NO: 2819 - protein, 49 aa, Homo sapiens
LVVKRLVKLELKVLCWMKLKTSTSHFLLLEMLFLLWLRVVHMFHIEIVK

SEQ ID NO: 2820 - protein, 91 aa, Homo sapiens
RVWKRQWQKNFRLYTTCANSLFRTWLQELKRVLRLILMTPEAALLRSKKSPFLKIILNSSLKCTNSWYVIMQISAVNFLSWKSDFELQLRE

SEQ ID NO: 2821 - protein, 22 aa, Homo sapiens
INVENMTFYVQQDTLVEWCGIL

SEQ ID NO: 2822 - protein, 195 aa, Homo sapiens
RQTQRRKELPYPSIYLRDVLSSSFLPGVLKSEQFLKRHFCEPLWTIPVTVLKSAGYRSCAVNKGQPIIAALYEMPVPACWISSSLSLLASHHSVSCSNIFLNFNPDHIRVQAQVYFTQESSILSSTLWNFCLLPQQRFCGREYVQAGWPCWLLQFFSQTYMHPMKTAGKPWLLRYPSLLEQQILSTYQMTPQSPS

SEQ ID NO: 2823 - protein, 63 aa, Homo sapiens
KPKQLLLLLWFLPRAPETHPTQPASLLRKYRTKHCRLISLLTCGMGYWVSVIQNTPTFAMGGR

SEQ ID NO: 2824 - protein, 37 aa, Homo sapiens
LTRHISSSLINSLLARLCMLQLILKMLHTGFQEQHLP

SEQ ID NO: 2825 - protein, 61 aa, Homo sapiens
KKPGMSYKQCMKHSSSSTRLKKQNERIGLKSFTPGSMKSFGTLTLKKQRSTKCNCKSSLTT

SEQ ID NO: 2826 - protein, 39 aa, Homo sapiens
ACSCWTRMTTRPRSCTPPSPQTVPLAWSWRPAPQSVATW

SEQ ID NO: 2827 - protein, 39 aa, Homo sapiens
TQSWCWSAPWTGRKRLLTTWSSRPRMAASRLALAQCAST

SEQ ID NO: 2828 - protein, 59 aa, Homo sapiens
RSWTPTSPWKAKSGEPATGAGAPRPARSWAAPTCPPITTPHTSTRTSRRTPSTTRATCS

SEQ ID NO: 2829 - protein, 187 aa, Homo sapiens
PVPEGAGPQPAPGKQRAESQRREPEPHAQPEAGQRLPALLSPLPIQARAHPGARPALPELHAADPAEVGRGVRAKPDEPGEHVQGPELSHPVGAAHGVEGEDPQRRDALHHQEARAGPPAAGARPEDPGRAQRHDHRRRRGERDEDGALLEQGGEEAAPGEGQGAAAAARVHDAEQVGLSQGAASSR

SEQ ID NO: 2830 - protein, 138 aa, Homo sapiens
ASCRGFPTLENTPLGLSRSCWSMECVRRWREFGAQRGLQHHQDLSTPVLRSDVDALQQVVEEAVGQALPGATVTLTGGFRRASSCTTSTSTAAVSPLPAWPNRATWTLLREVSAFSAYHNLQGLLWGDPRGPAHPGRP

SEQ ID NO: 2831 - protein, 109 aa, Homo sapiens
RLQLRSDTCCDGRDLSRGGRQLAGAQDGSCSPGLHPPSSAGHKLVNREPGSWAACTCGVPAPPGGGWAKEGASEPSMDACLCLPAPYAPHTPQHWPLRGSGDTGRGSRL

SEQ ID NO: 2832 - protein, 105 aa, Homo sapiens
PNSRKRHHQDLSTPVLRSDVDALQQVVEEAVGQALPGATVTLTGGFRRASSCTTSTSTAAVSPLPAWPNRATWTLLREVSAFSAYHNLQGLLWGDPRGPAHPGRP

SEQ ID NO: 2833 - protein, 64 aa, Homo sapiens
CAACRTRASSCTTSTSTAAVSPLPAWPNRATWTLLREVSAFSAYHNLQGLLWGDPRGPAHPGRP

SEQ ID NO: 2834 - protein, 55 aa, Homo sapiens
RRTRAAPCSPSPTTPSTSGPHPQRSPTPSSGRARSDTRAGTVGRSSPDQPISPDT

SEQ ID NO: 2835 - protein, 207 aa, Homo sapiens
SHHQAQRREAHPAHAQGPLGPRIRRGAAAGPEHRQPGPCQPKRRRAGAPQEPRLWGTQAGRRRGAAPGVPGADAPAAPAPLRQALALLHGPHLQQGRKAEGHRPRGSPEGEVPAAVPAALPPPDVSHRDHDREAGELCSHEGGLGQLPAAPPPPPLQLPVPTPNALRPHPQEGQGAIHVQVLWEDLPQISQSHQTPEDAHWGAAVQV

SEQ ID NO: 2836 - protein, 151 aa, Homo sapiens
CRGSLSSLSCGSWHPLGALGRAAPGWSVPTRCASRGAPRATPHGSWSLAVATASSPRGPPRTRGATSVATSSGASCAKACSARIASSPATTAAARSSAWTVAGPGTWAGNPRWSGTRTWTSLWSGRHLTFLKLRLSRRSRSTMPRSTATSS

SEQ ID NO: 2837 - protein, 40 aa, Homo sapiens
LAGRAGTRTSLWSGRHLTFLKLRLSRRSRSTMPRSTATSS

SEQ ID NO: 2838 - protein, 79 aa, Homo sapiens
TGTPSACLNYITSYVSCSGRRRSTSARSCRSTPIAARRSKRPCTPAPLGDLLYPQVEGRQQAAPSACRVSVTGPVGPVE

SEQ ID NO: 2839 - protein, 155 aa, Homo sapiens
CRGSLSSLSCGSWHPLGALGRAAPGWSVPTRCASRGAPRATPHGSWSLAVATASSPRGPPRTRGATSVATSSGASCAKACSARASLQIASSPATTAAARSSAWTVAGPGTWAGNPRWSGTRTWTSLWSGRHLTFLKLRLSRRSRSTMPRSTATSS

SEQ ID NO: 2840 - protein, 37 aa, Homo sapiens
VEVFLQLLEQEMLLKEQVLQTQLPVVNLQDQDRDLQP

SEQ ID NO: 2841 - protein, 35 aa, Homo sapiens
QRSHLPEVRGGQEAGAQTIGEPEQELKEVGHLCIQ

SEQ ID NO: 2842 - protein, 46 aa, Homo sapiens
DAVSLHLKQDLQAQDLLDTVQPDRRFLLVLELSVPHRATRGHLLED

SEQ ID NO: 2843 - protein, 44 aa, Homo sapiens
NFRRQSPETTSMCCWLLNSWWASVCLFLSDHSMLLLSGMLQLIL

SEQ ID NO: 2844 - protein, 193 aa, Homo sapiens
RKLALHCHHQQALPCLVKMQRLQQILIWKVMLMTIVLKWRNFFLSISSHLQVPALVLPPALHPELVPASHLQYQRVLYLPFPSDQAEHRQELLGLPVHRVLLLTRSQQRRCRRKTPPSPWSPSGRRRPARSPLPHARLPHRDLLRLQDAVSLHLKQDLQAQDLLDTVQPDRRFLLVLELSVPHRATRGHLLED

SEQ ID NO: 2845 - protein, 42 aa, Homo sapiens
LLTGCRQFSAPTRSWCSRRASCRSLPSSRRDRTSIPAWCSSG

SEQ ID NO: 2846 - protein, 42 aa, Homo sapiens
LLTGCRQFSAPTRSWCSRRASCRSLPSSRRDRTSIPAWFSSG

SEQ ID NO: 2847 - protein, 72 aa, Homo sapiens
LTSWEVILTPMPLPVPSSSCASSPLAAHCLQAAEEAASPTPCLESTCGSGSSFSPPCCARTSVSSRRLRQGS

SEQ ID NO: 2848 - protein, 144 aa, Homo sapiens
IPSRRMKTGNILSTYTRPAARSKFSSPKVQTESKKRIGKKWRNEHLMKRRNISLPMRQPYSQSVLHGPRSRMSITPHHLASTVPIAVFLLGKEMVHQTTSQSHPLQSQITSYQQPHLRKLSSGCIEIVFLHSQGFSQTSQGQIY

SEQ ID NO: 2849 - protein, 136 aa, Homo sapiens
IQWSSCGTLQRGHLCLFSPKVQTESKKRIGKKWRNEHLMKRRNISLPMRQPYSQSVLHGPRSRMSITPHHLASTVPIAVFLLGKEMVHQTTSQSHPLQSQITSYQQPHLRKLSSGCIEIVFLHSQGFSQTSQGQIY

SEQ ID NO: 2850 - protein, 149 aa, Homo sapiens
DSVDGCYRGYRALLLPLHHPLCCGCLHRRHRGHRGGLQLQFPWVYYLHLWPGCSVIWTFFTSLQCLVLESETKEQESQETGESNSSRGKSEKLVCLRLNTTKWAIGPGKRALTLSPNSPRTMVGENRLGVGADWKNGGGRVEGLLLCEE

SEQ ID NO: 2851 - protein, 55 aa, Homo sapiens
GSWSSRFGRRGMNISQRSLRKSPGLEPRSRSWRRSVSSQQVSFYKMSESTRAGVR

SEQ ID NO: 2852 - protein, 130 aa, Homo sapiens
AACLYPLCGAAGGCGDHSLWTHLLPALPPRALPDGGPILGQDPALPALPRGGAGRDSHGPCAPGPAGRNLLRGARREDLLLLRERCRVPLCVLQGGSHAPGAHRGVPGRGHSALPGSSQESTGSSEHGER

SEQ ID NO: 2853 - protein, 35 aa, Homo sapiens
ARMCGGWGPVASPCASRPPRSVSALWNSTPTSWRV

SEQ ID NO: 2854 - protein, 152 aa, Homo sapiens
PPGKPRRIPSSGVYLLPLARFRYALRNARLSPLLHRAPWTRRTKIQGDGCRNHRSIFNAPSLIQQAPGRKPGTRQRHHKDWWGSVSLGTPWKSSGLALGVKMWGLGPLPRQVPWLVPVITATQEAEAGGSLEARSWRPAWMTEGDPISLKNK

SEQ ID NO: 2855 - protein, 59 aa, Homo sapiens
VCLLHQPSPSLRPHPGLHQPCGYITRMAGCPVFHSSWFCCPPGLSMMRQPLLPCRTSSF

SEQ ID NO: 2856 - protein, 54 aa, Homo sapiens
KISLSSSKMSSRQVPWLVPVITATQEAEAGGSLEARSWRPAWMTEGDPISLKNK

SEQ ID NO: 2857 - protein, 47 aa, Homo sapiens
VPSSWTGSRGTRPRPCSDSRPATCPWALERAGRSTSAGSSGNRILSS

SEQ ID NO: 2858 - protein, 103 aa, Homo sapiens
GKRRCGGHPSQEGPGWAGGAWDAALLAAECRAVGPDPEEQGRGPAQTRGPQRARGLWRELEEAPQRGVRETVFYQANGICCRRKKALHCLSTPTPSLHLDPDV

SEQ ID NO: 2859 - protein, 35 aa, Homo sapiens
IAKTVVQKTIMDTVLTKHQRDLAHYMQSYIFPLIL

SEQ ID NO: 2860 - protein, 122 aa, Homo sapiens
KENLRAGHLLVRTQCSRFLRAVTPKRSPTNAASVARPSAITHSSSSIREFTLERSHISAGSVGKPSDGVPISTDIRGFTLFKNSMIAMKVKRLQMWSQKSSLVRNVFGVKNVGKPLHVKEPF

SEQ ID NO: 2861 - protein, 20 aa, Homo sapiens
PSPRTSGGGWTLLRGTCTGM

SEQ ID NO: 2862 - protein, 121 aa, Homo sapiens
ERNTGATSSGTMWRVITSSSCALVQTAPWLFGYRSLELAEYSAIGATRSSVSSVVRCITHPQTVPQSGNGSRSVQTTLKQPTTLVLTLKTVPSATSALRRMEAAITCNAPNVNTVSSKLGV

SEQ ID NO: 2863 - protein, 120 aa, Homo sapiens
ERNTGATSSGTMWRVITSSSCALVQTAPWLFGYRSLELAEYSAIGATRSSVSSVVRCITHPQTVPQSGNGSRSVQTTLKQPTTLVLTLKTVPSATSALRRMEAAITCNAPNVNTTSAGCV

SEQ ID NO: 2864 - protein, 124 aa, Homo sapiens
SLPVPTWLPGYSWATWSDRPRGSQRITWFARKRWCSWISGCPWTSRCQRIKRPTRKKWGKREPRVWVSWRTRSSWSPRSRGPSWNKQRRSSRRPRSPWQRWRPWKTWNPRATRPPRHLRPITMF

SEQ ID NO: 2865 - protein, 106 aa, Homo sapiens
CGWLWLAAATASWIRSMRRWRWQSGAARGLSTSCCAAATSRRCATRRIYAAWPCRPSIVTCKPSTGITLERKRLQFSRSSLGETMKPQIICKSYPMVAGWHQTFII

SEQ ID NO: 2866 - protein, 118 aa, Homo sapiens
CIKTAIIFLQLYQRFFVGKRFLAGSIDLPTSAPVYPFYRVASRRSGSRPQPCSLVSAKNSRMNWRKQRMLPHPLPWQALQQAPDPGATLNYKCLQSHTFRTVSGSRISLEKSKQRSIL

SEQ ID NO: 2867 - protein, 95 aa, Homo sapiens
LAPRRRKKPCWHSILQHQLPANIFGSVEWKTRPFISMQNPVRSRLYQAARYFLKEVDFDIVGKLPKRWWRPVPRSRGSLLRCTEPTLLRAAVPTP

SEQ ID NO: 2868 - protein, 39 aa, Homo sapiens
MKRKTELQMPLMLQELLLKKALFWEGVVPSFDAFQPWTH

SEQ ID NO: 2869 - protein, 145 aa, Homo sapiens
PAAFNPCPCPMTVQPLAPSATSQAGASPTTHGTHSRICSSASTSPSSPMPPAMVCIPGESRATWCVQAASRGRMPARVILGAPWCVGESFKVWCPGGLWGPVDKMASLESTPIFATPLLLAWELLGTLTPASPSKTHERGERSVQ

SEQ ID NO: 2870 - protein, 122 aa, Homo sapiens
PAAFNPCPCPMTVQPLAPSATSQAGASPTTHGTHSRICSSASTSPSSPMPPAMVCIPGESRATWCVQAASRGRMPARVILGAPWCVGESFKVWCPGGLWGPVDKMASLESTPIFASMWTGSG

SEQ ID NO: 2871 - protein, 103 aa, Homo sapiens
PQVGPHSGSLQRQTHSRICSSASTSPSSPMPPAMVCIPGESRATWCVQAASRGRMPARVILGAPWCVGESFKVWCPGGLWGPVDKMASLESTPIFASMWTGSG

SEQ ID NO: 2872 - protein, 63 aa, Homo sapiens
GTTDLFPPPPPPPLNLGTPLALRAPISPPSLPLAPLLLAWELLGTLTPASPSKTHERGERSVQ

SEQ ID NO: 2873 - protein, 55 aa, Homo sapiens
RCLRGGKTVSWGIPRSCSPNISCRKTTWSTGRSPAVILHVMNSCGVQGPSLKPAM

SEQ ID NO: 2874 - protein, 115 aa, Homo sapiens
KEALVLQLIQKIVLSLPVQWEVYLVPRSGSLQCRQYMDFISFVVLIGKRYILIQKKIKLKMFFKRISKNVWVLLSVLKKKTVIAGNHYPWLISMKKLQKICISCQTSFLLLVEQW

SEQ ID NO: 2875 - protein, 110 aa, Homo sapiens
QAHPEGLGTSLLVAPCLPYARHTWGTAMALTRPWHSWWGCWLLPRHSAGRRRSPTCWPCCGASVRISRKLRMPASLSSASCCPSFCPRQPCPLNATGICRPGWHASWEAS

SEQ ID NO: 2876 - protein, 61 aa, Homo sapiens
CRSRTAPARTTRRCRCCGTRRSRWPCPWCTRWWRRSASRATSSLCGCCAGAWGPDPRRSSS

SEQ ID NO: 2877 - protein, 165 aa, Homo sapiens
ATAAPLPWLFKAPFSLLGGPCLFQSMPRASRASPPRRPRWRPNESTRLPRGLAVPAQGHLGRTHPHSQLLVAGGQVETLPDPQTSVPVPLHSSPHSPAPPTTSSSASKTLVLLSLLRKKKTKSGVFFCFLFFPFPPAPTHGAFFWRWGLGNEGLRSRKGFYFFEF

SEQ ID NO: 2878 - protein, 29 aa, Homo sapiens
LFAENTDKLFEKLSGLPWCTKGYYVFRGS

SEQ ID NO: 2879 - protein, 85 aa, Homo sapiens
SFMTSGNRGMQEGGCGTTAFRPGTPFSSSSQSPTDGVSPKFQRPYFGSGLGGRTTTYPLSSLETRATWPAPGRYHWRRAATWPGR

SEQ ID NO: 2880 - protein, 141 aa, Homo sapiens
CRTWARRSWRRRERMILGNMRGVGMRQAKGTDVGGHGYPTGTPTKGATNSVKDMARGSTNLKMVLDISENMLEIKSTVKALLYIQMDPDMKESGQMTCGTAMAYTTTSIMTPTLESGLLIKGMGKAPIYTRRRAVSMLAPG

SEQ ID NO: 2881 - protein, 103 aa, Homo sapiens
CRTWARRSWRRRERMILGGSTNLKMVLDISENMLEIKSTVKALLYIQMDPDMKESGQMTCGTAMAYTTTSIMTPTLESGLLIKGMGKAPIYTRRRAVSMLAPG

SEQ ID NO: 2882 - protein, 43 aa, Homo sapiens
KVSCRVMVMILITSLHFSLEQQPAFTSVIYLSTTPAGGMSNLF

SEQ ID NO: 2883 - protein, 160 aa, Homo sapiens
LESAPEHLSYLAPTDTGGGFACPGCNHGVQRGGGGDWPAGAAWGPAQLHWASHSHPHCLPHWPFCLPSCWRPSWLPLGHLSLLHSPDHPLLPVPAQPHLPAACLPLGQGPHSPPHPDLQNVSYHAGHHDRVAALLCPDLDRRAAHRPKSLWLPGTNRCPW

SEQ ID NO: 2884 - protein, 156 aa, Homo sapiens
LESAPEHLSYLAPTDTGGPGCNHGVQRGGGGDWPAGAAWGPAQLHWASHSHPHCLPHWPFCLPSCWRPSWLPLGHLSLLHSPDHPLLPVPAQPHLPAACLPLGQGPHSPPHPDLQNVSYHAGHHDRVAALLCPDLDRRAAHRPKSLWLPGTNRCPW

SEQ ID NO: 2885 - protein, 131 aa, Homo sapiens
KVSSITVLMMMRTTVLTTHVLAASLTVVHDGQPWVSCPSFCLVYGVTFQPRVALNCARGVMTGLTGLVAAVKTQTQFAAKFPLSPLGTLKNQHSIINQEYYSNEDFFFLFLIHICNQLNSYNLGTVNRKVG

SEQ ID NO: 2886 - protein, 28 aa, Homo sapiens
KSTASPLENYFHCVFRKILPKGPQQQNF

SEQ ID NO: 2887 - protein, 121 aa, Homo sapiens
KVRESQRMREVQKMKESQTRKKSRTWRGRQNARESERMRESQVMRDNWKMRETRKSRASLKVRTSHKVRASQPPRPSQRASRGPPKSARLKIMCPGKQKEKPTGGRTIPPRTLRRTYKKGI

SEQ ID NO: 2888 - protein, 95 aa, Homo sapiens
PRCPRTCPPTCATSSLPATSWPCSLPAPSPAGRRWRSWPRSTSAAAAWTRCARAPSSICPACASSTSATTHWPTSVPSLSRAAMPASRPPVPLWN

SEQ ID NO: 2889 - protein, 145 aa, Homo sapiens
CETPEILHHQIKCCGDLIVLKTNTVTAQVTVRPKMCILTELERGMVGPVTLHKKIHTTTVLFIVQIHILLIQAITQAKLQMHLMILQMTGLSILALLGKSTTTIVEQKFHNGKNQKSGLKENRDKKKQTRWQSTASQKIGITEER

SEQ ID NO: 2890 - protein, 188 aa, Homo sapiens
CMRGNSRDSVMAVTTGGGTRSLTRHLSIHRRVTPVAVITDMKRCETPEILHHQIKCCGDLIVLKTNTVTAQVTVRPKMCILTELERGMVGPVTLHKKIHTTTVLFIVQIHILLIQAITQAKLQMHLMILQMTGLSILALLGKSTTTIVEQKFHNGKNQKSGLKENRDKKKQTRWQSTASQKIGITEER

SEQ ID NO: 2891 - protein, 138 aa, Homo sapiens
RGVTTCVCLSWASSRASGGPWPCSAGSVTELSASCCHPSTSPTCTACGTSSSALLPTWAVYALPTLMLPQRFLSKALSSSSGPMRNGPSLVSPMCPSCVPTRNHQSRSRDGKMVAGFSAYRPSCSGLPLLGRQPREFE

SEQ ID NO: 2892 - protein, 71 aa, Homo sapiens
TQLIIQKPLGENNVKLKKNLTYLLLNVLTYAWILLKLLMMKLVLPKKKVESLLISKAQTLTPQKKMIWMIL

SEQ ID NO: 2893 - protein, 21 aa, Homo sapiens
ASYVTVELQILWTRPCLSPFV

SEQ ID NO: 2894 - protein, 108 aa, Homo sapiens
RTSWPSPPAWSPTPPATWRPPPAPPTPRTRGGPWSPRCFLCWPGPCCCWRRPLLPECPVPGAPASPSRSSPAPHLLSSCLASSPSRHPRSPYTEVLPWNLPLPVRSGD

SEQ ID NO: 2895 - protein, 102 aa, Homo sapiens
GVCRSAGMPMRRLFFANMDAQPMMPTPNIIAELPRCTGRRSGSWGVRPWLGMALIPLPGMRQPLSLQGPSSQPRLQRAVAWHSRSMAPTQTCLAPHPKPHWN

SEQ ID NO: 2896 - protein, 69 aa, Homo sapiens
VVPFLITPQRRRTLISSQNTLNPLPGMRQPLSLQGPSSQPRLQRAVAWHSRSMAPTQTCLAPHPKPHWN

SEQ ID NO: 2897 - protein, 219 aa, Homo sapiens
TCPSELRPPKALSCCTSPRWYVSTSPSSRRAGTSTPWRLPPALCRTSVPATGCGPRTSAPQCAKSAGCRCLWNCCSLRPTRWCAPSPSLCATSRWTGATKTSSGATPWLSLCGMCAMHRLRRDRGPAWRKTPWWRCSTPSTKSCPTAWITRARSCRHAGCQRWWLSWPPANRYAKRRRRHTCCRQCGATRSCVVPCRKMVGPRRASSQLLLLPRGLREH

SEQ ID NO: 2898 - protein, 30 aa, Homo sapiens
LCACPRAPASPSASSAPWALTLSGRECLWL

SEQ ID NO: 2899 - protein, 87 aa, Homo sapiens
RQHRAAPGPGLPKGTGPGVRTVPHRRRLGPPAGHRPPAAAPPHPPCAGVRPCGSQAEGVCHHQPEGAGLRDPHVWGWHQRRGRPEAC

SEQ ID NO: 2900 - protein, 69 aa, Homo sapiens
GGLSPSQGGPAGAGGDAGPQEDVRQPPGELAHGPLLPAQTGYRDRRDCGSTAILPVSAQPDRGRGRAGG

SEQ ID NO: 2901 - protein, 208 aa, Homo sapiens
TTRKPRRKTRRPRARRRKRRGPRRRVSPRRPQSPPRPRRARRSPTRTPRARPRRRRARRTRRLPRRRPRRRSPRRRRARQRPRLSPRRRPSRSRRPPAPLRAARPPKLLRPPRPRPRARPLPPGRSPARRKGNPKRLRRPQLLPPRRPKVTGPQLQTQNPAARRLPPLPRRPPQPRKRLVPHPRPRAPQPLQKSPSRWRPRQLIPTKP

SEQ ID NO: 2902 - protein, 72 aa, Homo sapiens
LLQHDSTMLNEKKITVPLVQAVRVLKKHPQMVPLAVLGTAAETVVSQVQMVAVRQLGRWCLYMKMQKKELGI

SEQ ID NO: 2903 - protein, 53 aa, Homo sapiens
ARASTSWTSTICRASAPCATSCARSTGAWTCWSTTRASPSRLLIPHPFIFKLK

SEQ ID NO: 2904 - protein, 25 aa, Homo sapiens
DHHHQFQERGEAFQCDQHTENQHNN

SEQ ID NO: 2905 - protein, 37 aa, Homo sapiens
SAGCIMLQMLLTTGLQPGPILQVSSLLCSFTGNLRKI

SEQ ID NO: 2906 - protein, 84 aa, Homo sapiens
RGRGGARRRALPAALRARGPPAAEAEAADGLPPGAAGAAIYRQHLFPGSLIRASPCLHEKAEPGVRRDLQFRSWRHINCGSKWL

SEQ ID NO: 2907 - protein, 106 aa, Homo sapiens
LLKALSLMCGPLAAFAMRMTCSLCQLFSLRYSGTVRQAWPIPLGILSSIPSNTGCWYICGAGQNRMVVQWPRGASSSILTNCGSCECGKCSFWMKTTCLSSTLVRM

SEQ ID NO: 2908 - protein, 148 aa, Homo sapiens
NGTRGLGGREPGNRGKPSGSGHTGDHRADGDAFRSPGERLGGSAEGCAVQPGQCPECPLLAAWPGHPEGPCVQVPGAAVRGGHGAVCRPVPEAPTTLWQPHQHHPHARQRLAVPAHATELRDRPQLCPCEDAGHHVSLVPGGDDAELQ

SEQ ID NO: 2909 - protein, 21 aa, Homo sapiens
EPDWSIRAKEQTQAAAPGEAK

SEQ ID NO: 2910 - protein, 50 aa, Homo sapiens
ALRTLAPQLKVFWIIKIMKVHHVTGKSPFQRSLKFPSMIPQRGVQQITRT

SEQ ID NO: 2911 - protein, 36 aa, Homo sapiens
ASLCGCSASATTLGSSSPGTQALPTWRGHWSIRPHL

SEQ ID NO: 2912 - protein, 89 aa, Homo sapiens
GPGGADFIREAVAGADTCVFGRGSGTQRGFRALRPRPLPGLAPGPRRERTEPSSSEAATGRRGAAHCENSLYESSRATCLGQLPRRGKG

SEQ ID NO: 2913 - protein, 51 aa, Homo sapiens
NRTLRSSYINCVPKLKLRENVWHHYRHHHHHHHHQQTTTTLRKKNTKRNQK

SEQ ID NO: 2914 - protein, 33 aa, Homo sapiens
LLNVDMSSWGLLLEDFQRSAYTQQFLLYMATQK

SEQ ID NO: 2915 - protein, 103 aa, Homo sapiens
GENGMPGASHELPEHYLLIRSQNVGHTGKRMMLRCLCRLTSQTSFQNSEVSFWKQNPRRSTSLRRRRKRDRLFSSNVVMGLSKSSGDFSWPLDCSTRVPIQNS

SEQ ID NO: 2916 - protein, 55 aa, Homo sapiens
TEHPRKGKARMDLAREASVRTGQRHPSQTLRRLSIPPQAQWALMPLQVWLVSMTT

SEQ ID NO: 2917 - protein, 125 aa, Homo sapiens
SLGHRPRNGGHSRGCDLGGLHAHSPDPRLQGAGLQQAKNAAYSVSLPPGCVGHLWPHLRLHHRTGREHRAHTLLPLWDPLFHLLLLPAGSCCQSDQARPGEEAPFPVGDSGSGRGLQPSPGCYRY

SEQ ID NO: 2918 - protein, 132 aa, Homo sapiens
APPLDDLRVSGHGFLPLLPHCHGYTAFLPGPHLEHSPLPADGAAGGHYQGHLRLLPSGQCRDDLHVPLLPPLYVQPSAGQDLCHCYHQQIWLGHLWPKNHCGELHWPHSCVHLGGSSPGRAGLHSLLPGPVQ

SEQ ID NO: 2919 - protein, 57 aa, Homo sapiens
PMPRAACSCAWRRWPTGCATPWPWSMPGMAPTASSWPSRWGWCGPTCPTARGWGSLS

SEQ ID NO: 2920 - protein, 139 aa, Homo sapiens
PPPAVTLQGAHLEPSPTGSSGRAPTSSSSSHSISARLSSTSPRTALGATEGSRPTSLPPWPRLRTPSRTTAPATALCTRIWLQPLPLPTSPPSPTSTPTLRRRPWAPPAPWPTWWPRKALRATPCSTLPTQPASSTRSP

SEQ ID NO: 2921 - protein, 89 aa, Homo sapiens
STARQYPGHHQAGHPAPCSPRRREAHLRPHLRGDSRGAEGVPGERDPGRRDLYRARQAQDGHRHGCGLRAQAPGPHPLRFRWLSVPFYQ

SEQ ID NO: 2922 - protein, 78 aa, Homo sapiens
HLWSSPGQHLDGPADGSECRGLFCGRTWRLSLRTGGIRKLGHRRPGLHARGLGHSHGCESPEASGSWKLYLSSPEQKN

SEQ ID NO: 2923 - protein, 49 aa, Homo sapiens
TSTERAGESLQPHHHQAVPECRRHARRNAWGISWWWSSSLWWCFLRAHH

SEQ ID NO: 2924 - protein, 29 aa, Homo sapiens
THRHARRNAWGISWWWSSSLWWCFLRAHH

SEQ ID NO: 2925 - protein, 76 aa, Homo sapiens
SLALEVPWPLWVQSICVPSAFHPPIASQNSRLSSALSTPRCSPSLVDWSFQDPEKQVRDLRTWLMEVPSSTGPEAP

SEQ ID NO: 2926 - protein, 37 aa, Homo sapiens
DVLDKENLVTPWIGITHKQTKVFPLRKEIVCLPQANF

SEQ ID NO: 2927 - protein, 27 aa, Homo sapiens
RSYSRWSQSIHRKESTANTFRNRNGLC

SEQ ID NO: 2928 - protein, 67 aa, Homo sapiens
IRHPSQQPQQLYRSHLLSQPSSICPGQKLCTLTLQAYRKAFLTSPPALLPPRKMFRLHSQISPRTVL

SEQ ID NO: 2929 - protein, 21 aa, Homo sapiens
WLIWRAKCPLCLPGTGFEICC

SEQ ID NO: 2930 - protein, 104 aa, Homo sapiens
QPRDHCQPAGPVPTCQVCHQDSGGGVVQDQAGPQRVPGPEPAPAGAGGYAEAGAEGDGTAAAELTPADRAAPGADCHVRVRAGAGPWADAGGDAVPGRGQEPGH

SEQ ID NO: 2931 - protein, 112 aa, Homo sapiens
RGSISACPSFLWVILMTSHGPSSLPWRRLKSFWRRTWSLESRRSLRATARTWMPAASSQLGHTRATSILGPAGESAVPLHQVVPVQEVPRAQVGAPRLMAPSQCCCRSSPCL

SEQ ID NO: 2932 - protein, 55 aa, Homo sapiens
QPGRSVDQNHSGSGEKGGIRTEDIFQSSRGHSHQPELLLQLRDQQPELRCQQRIL

SEQ ID NO: 2933 - protein, 68 aa, Homo sapiens
KNVVHFLKANLILVIVLEFLVLQKHMVAVTFIWQPLNTYARILKLFARLKSFLSLHMLTWMKLFPMTV

SEQ ID NO: 2934 - protein, 16 aa, Homo sapiens
LSVSSQTPSCWPHYPS

SEQ ID NO: 2935 - protein, 46 aa, Homo sapiens
LFLHRTDLQLLAVGQVLLIETLMIGKTLPILLVMSQITTELQVLTV

SEQ ID NO: 2936 - protein, 56 aa, Homo sapiens
GAGGSWPWVFYLNHISTQVLLLTFLENGRRRIKLFILHNCLENLGDQQKSTTVEDK

SEQ ID NO: 2937 - protein, 163 aa, Homo sapiens
EANKLPPWTGHREPEPHPGLPGHPCAAGSIGHWHLLLLCPLATLHGERQRHLHPGQRSGCGVQGRTPPGSAQIQDLPAAPSSILQNLSTQLCSAARPRSMPASRMRMAAHPPPSRAPSPRRDRIDSKMMANLTWSMKISRMGSTAHRACPGSEDRGSPCHQRT

SEQ ID NO: 2938 - protein, 63 aa, Homo sapiens
FQIHQHCPRRRRLDSSITFIRNDRRLLCQPVCQHRTPGRQLSEHPTAVSVLVPLIRSTKETTK

SEQ ID NO: 2939 - protein, 62 aa, Homo sapiens
RSLCSLCARMARARPPDSIRNDRRLLCQPVCQHRTPGRQLSEHPTAVSVLVPLIRSTKETTK

SEQ ID NO: 2940 - protein, 30 aa, Homo sapiens
GNYLRNMERQAKSSFIRIKDLALSAWKPEP

SEQ ID NO: 2941 - protein, 17 aa, Homo sapiens
PRGYSRSLAVEEVSLRK

SEQ ID NO: 2942 - protein, 29 aa, Homo sapiens
TQAAGGLETRHQGDNPGFPRAATNCSCIL

SEQ ID NO: 2943 - protein, 56 aa, Homo sapiens
NTELIRKMYIIGKERNTVLFLDPYKILCNRHIHVTFSCAQKGYHHPTTHIREHPGF

SEQ ID NO: 2944 - protein, 39 aa, Homo sapiens
SLQLSQPRWSQGTQERGPEPSQLPFLWLVWRSSPQNFQG

SEQ ID NO: 2945 - protein, 68 aa, Homo sapiens
LLAKMSFTYIWWTQQGRMSTAFCPIHSSLGSMVMCLCILSPLCIASKSLRVCTKSYMKAMGKPGCQWF

SEQ ID NO: 2946 - protein, 136 aa, Homo sapiens
GGGGEQRAALSLPSTRPFSSCNFGAQRNPGKPHGPCSGGHPGTPSTAPAGPCSAGGPNLLLSPGQQPSTRGQLSPPEWHSLAASTAAQAPAAFAKAPRDRRAAPAGLHCPDHLICILGPHPAENQGGGPRARKHWQ

SEQ ID NO: 2947 - protein, 32 aa, Homo sapiens
KSYMKMSPVVLKLKTLEANTVNKAKKQMEVSL

SEQ ID NO: 2948 - protein, 106 aa, Homo sapiens
PGPHFPVELHHGWESRRHGFHHCNISYRPHQNPVDHAEHTGTIVQGAPPCFFYYLPTGRVPCPLSRGFPHCCRCSPVLCWLPSCLHEPGENLERTPRSVLSPTELC

SEQ ID NO: 2949 - protein, 32 aa, Homo sapiens
GRFAWLISLQTSIKSCSSSRSFQPNFPELLSA

SEQ ID NO: 2950 - protein, 130 aa, Homo sapiens
VLPLPQTLPHAGRAGQAPAAALPPAGGACLHLQVLRQGVHQPGCPQDAHPHSHAALHLQDLWQGLLQALVTAGPCPHPHRGEALCLLALQQGLCRPLQPSGPSANALRRQEVPVPALHQDLLPHVPPGAA

SEQ ID NO: 2951 - protein, 36 aa, Homo sapiens
GIPHLCSRSQGKLVIVGSLKVKQKVQHLHQILQEHR

SEQ ID NO: 2952 - protein, 81 aa, Homo sapiens
KHLTPSQPGLSSQEHWMQVGRQYSRRRIHLAPPQPGSVIHMWLWEYLGFFCLYSWESLLCHLLAMQSTGESSDLSSPNWVI

SEQ ID NO: 2953 - protein, 64 aa, Homo sapiens
PLPRQYSRRRIHLAPPQPGSVIHMWLWEYLGFFCLYSWESLLCHLLAMQSTGESSDLSSPNWVI

SEQ ID NO: 2954 - protein, 285 aa, Homo sapiens
SSWSTRWLRPCPGSDSGMPPLAGAPMARLRPQGPCPWAARPPSSPQGPRLSSDPHHRAALHSRVQAPSARDPHCSSARPRRASSTFQALDPQLAAPCPSAFQVPPQRPSSPRPRPRRRPRVKAANPGQWREAPGRLQQPARPPLRLPSARRAPHRLPVRHPSLARLRQRPLGPHRAGSSARARPRNPQAQPAPHARPARRVPCPALGHPPRSSLGPAARAPLDVPNHSWPRNPARTCRHPPPPLQGDLRTPSSKPAPPRPSLSQDEVKAETIRSLRKSFASLFSD

SEQ ID NO: 2955 - protein, 68 aa, Homo sapiens
SEEPLERFRMWAKVPPPHKALGSPRSPHRQTWGSRPRVGPREEGLNVGRGITEWKEIEGAESAFAVMS

SEQ ID NO: 2956 - protein, 159 aa, Homo sapiens
YQVRGLRGPSRRHQQRDGTVAPAGHCRSISLHERPAAVPHPQCRLPAPILPPTLPAYLPPVARSLLPRQRPLQPEPPARPAAAAAPRLARPEAEPGVWAPAHAPGAASPAVGPGSSQGLQAARGPPARPTRAQLRTRRPLDPLLTSRHRGGPACRRPGY

SEQ ID NO: 2957 - protein, 26 aa, Homo sapiens
TLMRKKMARGKERNLWKTIRRQSLTP

SEQ ID NO: 2958 - protein, 123 aa, Homo sapiens
SLTASRMTRRSKDGQRLWSPRRCWMLKWRTSRSPLRPCGPGWSAASRCSRYCGPSRHVTATCKRATWSGSTSGQLSTWRCCCWWLCCRSARSSASSRTSARCPRSPCHGRKNGTKEGQQGVCI

SEQ ID NO: 2959 - protein, 81 aa, Homo sapiens
GLCTTSFTVSGTGARRIEAGPSPAGPEGLLSCVLWEGMGGAPRVCVYQGVSSILPWVLWALWALKEDLGPVPSIKRGPEVA

SEQ ID NO: 2960 - protein, 81 aa, Homo sapiens
KCCTWMTVRVAVPQSWTRRSRAASTLTPRCSCPLAARTAPCPTPHRHPLASHPALPSFPAPLSPSPSPPPPSLPPNLAPLR

SEQ ID NO: 2961 - protein, 56 aa, Homo sapiens
LTWTCCHPSTHPRGPCSTQRHNQDRILWALTPASKRTLASMLPLCPPRPYSPVTRP

SEQ ID NO: 2962 - protein, 64 aa, Homo sapiens
GPSCPRTTHPPSCMTKCSTSSRPCSTQRHNQDRILWALTPASKRTLASMLPLCPPRPYSPVTRP

SEQ ID NO: 2963 - protein, 20 aa, Homo sapiens
IVTGGQSRSARSWGSSPARY

SEQ ID NO: 2964 - protein, 84 aa, Homo sapiens
ALRTRAPTRAWACCRRRWASASRGASSSRRQRTTSPRPSGTTPRRPSTTCTGPRAGSCCRTFLGPARMWPLSCSSTPSNQSCPC

SEQ ID NO: 2965 - protein, 32 aa, Homo sapiens
CQVTRPLGEEMIPSTPSSVRRGLASMCPGQCL

SEQ ID NO: 2966 - protein, 67 aa, Homo sapiens
CVSASPSTLARLVSRLAMPAGSSTAWNTASSPMARCQVTRPLGEEMIPSTPSSVRRGLASMCPGQCL

SEQ ID NO: 2967 - protein, 94 aa, Homo sapiens
RLLRVSSRWASPGDARRRLWPSQGTRASRLRWTGCWSWWPRSSGSVKKERNGRHWNGNGSAGDKGKSCQQHDSGYRKMRCAGLLRRGGGKRPRS

SEQ ID NO: 2968 - protein, 71 aa, Homo sapiens
VKRKDRNKLRGCWSWWPRSSGSVKKERNGRHWNGNGSAGDKGKSCQQHDSGYRKMRCAGLLRRGGGKRPRS

SEQ ID NO: 2969 - protein, 72 aa, Homo sapiens
SADPPALQEAEGGASGPSAPRRPRPECAWWPGVWLWALHLPPHQRRSGRQRRAPGRGRDRPDQWIFHLLLYP

SEQ ID NO: 2970 - protein, 22 aa, Homo sapiens
LRAGMKYRVETRRMARRRRRRC

SEQ ID NO: 2971 - protein, 88 aa, Homo sapiens
KACTERSWRRVAMVRLGSARIQGPTGPSSPQALRVTGVGSWSRWAPWLCGPAKGKRRCLGGKGQWNGGRGLWKKGSEPWRRWKGPSWR

SEQ ID NO: 2972 - protein, 286 aa, Homo sapiens
GSTQASAPTRARTAPRPSRTRPACGATATCTPASGPTPVESAGRASRRAPTCGSTSACTRASGPSAARSAPRPSPTPPTCCCTSARTAPPPPRVPPPRPRPPSPGSPARSSCATPTCSGTSSPTARPRLPPRRPRPRPWCLSSFWRRRRPRWSWCTAAMAASRDSAARSCSWSTSRAPGPMRRPSPRRHPPRRPRPTSHRPLCRSPLLPPPPPRLALPVCPAASPSGRWLGSPATSTATGLPAGKRSAAAAATAPSRSWPASWRISSATWKRPRPGARPRRLRLRR

SEQ ID NO: 2973 - protein, 214 aa, Homo sapiens
PAPRNRWRLPPPSRRHPRPPPLLRSGPTNVPSAASPSRAPPGCATTCGTTRASGPTSVASAARPSSAPPCWPSTSGCTRACGPSPVASAASPSSGRPTTSTTCGCTLASGPTPAGSVARPSATRRACVATATCTLARGPTPAVSAARASRRPPTCGSTSACTRASGPSAARSAPRPSPTPPTCCCTSARTRRSAPSPAPSAVAASLWPPICSGT

SEQ ID NO: 2974 - protein, 55 aa, Homo sapiens
MNIKKFILERNPTNVKNVAKPLDGPQIGVNIRKFIVQINPTNVKNVTKPLNNFRS

SEQ ID NO: 2975 - protein, 106 aa, Homo sapiens
FILEKNPINVKNVAKPLIGSQPLLNIREFMLERNPSHVKNVGKSLPHPQTLPNISEFILERNPTNVKNVAKPLIGPQPLLNIREFILERNPTHVKNVAKLLDSPQN

SEQ ID NO: 2976 - protein, 27 aa, Homo sapiens
INIRKFILERNPTNVKNVANLWMIHKP

SEQ ID NO: 2977 - protein, 65 aa, Homo sapiens
MSVSCRKEVIMNLMNACQLPRAKYFSVKQVSKLLVNFQIQTNVRQDILERNTLKNVANHFRSFHT

SEQ ID NO: 2978 - protein, 60 aa, Homo sapiens
HAIVDVTLVRILTSVMSVARPSVRRHPLHAIVDFILERNLTNVKNVTKLSISNQYLKDIG

SEQ ID NO: 2979 - protein, 126 aa, Homo sapiens
NQTLKDIGEFILERNLTSVMSVARPLVGSHILYAIIDFILERNLISVMSVARTLVRSHPLYATIDFILERNLTSVMSVARPLVRSQTLHAIVDFILEKNKCNECGEVFNQQAHLAGHHRIHTGEKP

SEQ ID NO: 2980 - protein, 244 aa, Homo sapiens
FILKRNHISVMSVARPLGRSQSLHAIIDFILERNLTSVMSVARPLVTSHPLHAIIDFILERNPTNVMSVARPLVTSHPLHAIVDFILERNLTNVKNVTKLTVSDQILKYIGKFILKTMLTSVMSVERPLAGHHPLHAIVDVILESNLTNVKNVTKLSVSNQTLKDIGEFILERNHTSVMSVARPLVGSHTSHAIIDFILERKLTSVMSAARPLVGSHPLPAIVDFILERNLTSVRSVARPSISS

SEQ ID NO: 2981 - protein, 81 aa, Homo sapiens
PLNAIVDFIVERTLTNVKIVTKLTVSNQTLKYIRKFILKRILTSVMSVARPSVGRHPLHAIVDFIPERNLTNVKNVTKLSV

SEQ ID NO: 2982 - protein, 357 aa, Homo sapiens
EFMLEKNPLLVMNVERPSFRVHTLFTIIEFILERDPINVKNVVKPSVKIQPLFYTRESILERNHMNVMNVGRPLGLVHSLFSIREFILKKDTMNAMSVAKPSSIAQALLDTRKFILEKNHICVMNVGRASGRVLSLSGIREFIQGTNPMNVMNVGKLLARTQRLLDILEFILVRSPMYVRNVGRPSGGTQNFLDMREFTLERNPMNALSVERLSGGPLTLLSTREFILERNPINVMSVQEPFGIILSCFSTRKFILERNLMNVASVRKHLASIPNLSYIREFTLERSLMSAKNVRRLLVGALTSSDIKVFTVWSNLQNRKAFSGKAKVQLIHLFIICKYAPQVFKSNEWTEPPLSSH

SEQ ID NO: 2983 - protein, 151 aa, Homo sapiens
KSKDHLQQLYEPGAVQLPQRLPLPLLGAVHRPPPLAAAVHQRGVGLHIPRVRCLPSEPLDGRDHCDGPGADDGRAVRHDGPHRNQAQCRARGHPDRFCWHRSGVHRSRCFGLSDGHRRQEPQGCACPGAHVCTRPGWRRVHSAGSADAGGI

SEQ ID NO: 2984 - protein, 49 aa, Homo sapiens
TGLLHSKKLRQVLGCGPPHIWGLRGGIKSSEPRDQRGGAVGGSWRTSKS

SEQ ID NO: 2985 - protein, 41 aa, Homo sapiens
WCSILPWFCSFFLQFSAWIYIDARTGDWIFSAVLQAPASAE

SEQ ID NO: 2986 - protein, 36 aa, Homo sapiens
ERSFRDSYLNWVVTFKKTAASSWLWASSYLGPSRWD

SEQ ID NO: 2987 - protein, 116 aa, Homo sapiens
SWKPQKTPSSPTPLWSIPNPGITHPRTRDSSPTWTQGPCLPDGKASSPAGTPPEKACGHPPTDRAETLLKFLLKGILALAIGPAGALAGPVLTTLGTQRPLPWAAPCPATASPSPL

SEQ ID NO: 2988 - protein, 97 aa, Homo sapiens
FPDDSVRPQRGASALRGPAGRGRPCPPSDRGSHRKPRLRPLHCGPSRIQASPTLEPETAAPPGLRVPASRTARPAAPQGPPQRRLVATPLQTAQRRF

SEQ ID NO: 2989 - protein, 78 aa, Homo sapiens
WPRLVTPPSPRTAAAAAAAVSVPRDGRLEAGGADGRGGCAVLPRRTGTICTGPATATPPSLWSRFPRGRLLAGKRRCG

SEQ ID NO: 2990 - protein, 12 aa, Homo sapiens
WGRLLAGKRRCG

SEQ ID NO: 2991 - protein, 73 aa, Homo sapiens
LSPCTRRLSLGLGGTPEGDSAQATLRLTTACLRTPTCLSTSGVRGGIRRWKSLSCRTWNARRGPGEAAPTEGD

SEQ ID NO: 2992 - protein, 65 aa, Homo sapiens
VRAALRRKPPAAQRAGVFTLSVPFVKTEEEEKKKKKTEEKKKTTGETKRPAATRGRLLAGKRRCG

SEQ ID NO: 2993 - protein, 49 aa, Homo sapiens
VPGPWSSEKYRFGKGRFNKQRKEVTKQAGLPLQKVCPLRATSKSSVPEM

SEQ ID NO: 2994 - protein, 45 aa, Homo sapiens
LVLLHQICFLQQKVGSQMPGYGKKMLASMFVLDSSLPMWKKQSQC

SEQ ID NO: 2995 - protein, 45 aa, Homo sapiens
YSSIRYASYNRRWEVKCLVTAKKCWHLCSSSTLLSLCGRSKVSAR

SEQ ID NO: 2996 - protein, 43 aa, Homo sapiens
SRTRASPASVVYSTETYTHFSEKTHTRAKNRHQRKSTGISGFL

SEQ ID NO: 2997 - protein, 36 aa, Homo sapiens
MKSSKPTRLLFLHGPHFFEIYYKGGYELVKKSQTEL

SEQ ID NO: 2998 - protein, 34 aa, Homo sapiens
YFKKLVFLFIVPFWQQGVHFLKHCFLPHQSMGQR

SEQ ID NO: 2999 - protein, 32 aa, Homo sapiens
LRMFFMNSAKTICLLLSSLTTYRQVNKISLNI

SEQ ID NO: 3000 - protein, 84 aa, Homo sapiens
TVHLLQKPCLQIWTLLWPSIHPCPLHHLPTTPQLPQSITNSKQAGSKDLPVSTLHVHFLIPVIIRCSTPEQLLKLALPQSTCRV

SEQ ID NO: 3001 - protein, 73 aa, Homo sapiens
GPHPILSKAMVANQSCIALTMAMRNHKTKKREPLVLPPSKRSLLSVGNLIGLPIMPSRCENSSLGGMLEMSMH

SEQ ID NO: 3002 - protein, 71 aa, Homo sapiens
SQPTYLVRRLLKNRKKLGENIHFPLTGIYTDKRMSRYTWMSLSNLPSGQTFLWQPQKMLVPVQPMSGDELQ

SEQ ID NO: 3003 - protein, 259 aa, Homo sapiens
PLLTTCPPNLTTPSRAYTAVCRSTASPSSWRVSGTVRGCCSAPWHRRTWPPRSWGCRKPSVRRPTKLGLKHPAWSRTAASHPSRWRTTAPAWTLWPRVRGPGLGSRRPCPTPCSWTRAAMPRTSAQGCLKTLPWPSLRLTPKRQLVLSPLVPSPPLGFLLQTPLQQLLTVSRTQPLPAQRTAPTPLPGQRKTWGMLVPGGDCTLASLPRAWSRVGRPQMASAKGTPMRLRPAWASRRRTPLGRRWPRCPGTSSRRRWVG

SEQ ID NO: 3004 - protein, 113 aa, Homo sapiens
SQVKRGLMGSELQGIPPPRTPLWPRSPTSLLCPRRPSQRKSLCHGAKAYGAVGCTGGCPRPRTPHAGHQCCPKTSCSLNPAQGPPRDRWKGLEPQAGGPRKGSPGCVLVLSRP

SEQ ID NO: 3005 - protein, 106 aa, Homo sapiens
AATGSGCSPRTIITRSLTRAMRVALARPLALQPRWPPTSTTEAARPCPHSKACRGGRLSLATASRTAAPTQAAMLVRRAFRLGGPHSHHPHSRSHYLQGWPSMMRT

SEQ ID NO: 3006 - protein, 104 aa, Homo sapiens
KRQQCPPAGSMQSRAPRCPFGLTPCTSSSHRRPSSPWHTPSSKGRSCRTTLPPLCPSPRVPTFLSIPSPSPPPPPTPPLSRVVGRGPTPIRVAQHRLPSPMTGR

SEQ ID NO: 3007 - protein, 168 aa, Homo sapiens
VPLALFAASAKTRPTSRTLGTSVGPTTLNTASPKRSQNSRRRCGQKAPVRRPRCRLREHSKVPSVQLPPLPGSPPGLTAQLTRPSRAHCAPVPGACPGGCRAATAVMAGRMGARRQPQPTRVANMSAARRLRQSPAGRPRSTGCMRPVPCGPAASTWWPGSSLGCRRP

SEQ ID NO: 3008 - protein, 113 aa, Homo sapiens
ACPTAPTATTGEDVLAMTAVSHTSSRVVSWTPPSLMTSTFTSSHFKWILLLTILLRGARPVCHLQARGPAPALPSQFSSTPGSSSQTVARHQLFVVMMKMLHHCQPNLLIFIH

SEQ ID NO: 3009 - protein, 111 aa, Homo sapiens
ACPTAPTATTGEDVLAMTAVSHTSSRVVSWTPPSLMTSTFTSSHFKWILLLTILLRGARPVCHLQARGPAPALPSQFSSTPGSSSQTVARHQLLMMKMLHHCQPNLLIFIH

SEQ ID NO: 3010 - protein, 32 aa, Homo sapiens
PRGKRSNLKKWTRSQKGKASLTIGGWRICCSL

SEQ ID NO: 3011 - protein, 85 aa, Homo sapiens
GQHSQKQDRKPFHLHLAMKHLQSRIVKRKRMLQKRNVYTISKMLSWKQIKLSWPRHQPRPLCPAQLPQCSPATASSECHPRDLLQ

SEQ ID NO: 3012 - protein, 170 aa, Homo sapiens
VTCFMASARRTTDTRPQPPRGIAPRAWPPSQRSRLLRCHLLRSHLPPHLTLQILQPHHSPKQQPQLLGLWTHARVSVLHPYPRPQMAPLAPLQVSAVTLTAKGTAARMVSTTHSRMMGTRVQMRTAALSTAPAPRPPPTRRRASTATAATANSLGTAGLQLHQQVEIMQK

SEQ ID NO: 3013 - protein, 56 aa, Homo sapiens
RGKAEKGFVHTTTQICKTSSRGEVLPAALDTPAGTPRAAPAGHICGPQGDQVDTVE

SEQ ID NO: 3014 - protein, 110 aa, Homo sapiens
AASPQCPVLRRAAALHTAWTRRTCTQTWLAPCPQPALGPRPQPRPGRRKENLRKKTVLKRKSGKGIRPHNHPNLQNLQQGGSPPSSPRHPSRHPPGSPSRAHLWPTRRSS

SEQ ID NO: 3015 - protein, 19 aa, Homo sapiens
KKQLFEKNRSLILKRKGLR

SEQ ID NO: 3016 - protein, 76 aa, Homo sapiens
TFHQNQGRAGPAARESRREVSEEAGPASSPTTGHQNHCSCPRAHQARRPSGSQEEGAASQDPPQEADAKRQRQWQW

SEQ ID NO: 3017 - protein, 134 aa, Homo sapiens
VVNLLDMKEFTVVKNLMNVRSVESSLDLRQPLFNIKEFIVVRNLMNVRYVGRPLDIVQPLQNIREFILEKNPMNARHVGRPLDIVHPLPNISAFILMINPMNVRSVGIPLVLLGILLANRKFTLVRNHLTEINV

SEQ ID NO: 3018 - protein, 25 aa, Homo sapiens
SLMNIRKYILVEKTMNVINVGKPLG

SEQ ID NO: 3019 - protein, 184 aa, Homo sapiens
NLVNIWNMGIHVVFIKTLMYTRKFIMRSSINVRNTEGPLKELEKLLHFKEFMMVRNTLNAHSVGNPLECMHNLLDIRKSILMRKLTNVWNVARTSDFIHSLPNIREFILVRNPTNVCTVRRFLELVHSSLNIREFTLVRNLMHVRNVGRLLEYVENLLVIREFILVRNPMNAKHVERSLEIVHP

SEQ ID NO: 3020 - protein, 108 aa, Homo sapiens
ASATQPSTGSWCLSRTMASLRARPPPRCTCSWWMASPSPTCLSLRRPRPRPRPTLSPSTWWWRWPRCRRSSSSRCSCSWRCGCAGGAGRPRWVAARCPRAPFQGIWWT

SEQ ID NO: 3021 - protein, 228 aa, Homo sapiens
QRPRLHPNLLHPVRPREQQPRPAHRQCQRHRQRLGHQRPGHLLAAAAPGPAPAPRLPGLHQRRQRPPVRPQVAGLRGPAGVRVPRGRLRPRFSGFEQRGAGARAGAGHQRQLALRAVPAAEWLRALHRAGAPGGRAGLPGDQGGGGGRRLGPERLAVVPAAQGHGAWAVRRVGAQWRGAHRQAAERARRSQAQARGACQGQWRASALGHRHAARAPGGWLLPALPASP

SEQ ID NO: 3022 - protein, 103 aa, Homo sapiens
PCRSPTSMTTPPPSPKPPTPCSSARTTAPPCTSAVSAPQTETRAPTPRSPTRCCRPRTRTCPSPPWSPSTQTTATCSPSGRWTTRPCRRSSSAWAPQTAVLRL

SEQ ID NO: 3023 - protein, 13 aa, Homo sapiens
KKNWISKKLNLTM

SEQ ID NO: 3024 - protein, 47 aa, Homo sapiens
GWPYVNRRLKTDSIHGLYSMKKIKSCVPGWCRWKTKFYRQRTLVLKK

SEQ ID NO: 3025 - protein, 40 aa, Homo sapiens
WKVTGMFHLFPLRPAPLINHPMESYYYLQARMVAKKARES

SEQ ID NO: 3026 - protein, 36 aa, Homo sapiens
ITGKNSPSMCLRTWIQSEATSTIFLSFQKKLMKNPP

SEQ ID NO: 3027 - protein, 113 aa, Homo sapiens
WPQGTSGLAARPLSAWTPSPWSGTTQATWGAPPLTKRTRRAHTTAHCQVNPFRMATRGMFPTALPVPSITTSKWKVTGMFHLFPLRPAPLINHPMESYYYLQARMVAKKARES

SEQ ID NO: 3028 - protein, 30 aa, Homo sapiens
KNRISPLLTILEIFYLKKRKQLLSFQQICQ

SEQ ID NO: 3029 - protein, 30 aa, Homo sapiens
SFADNSMKKHQRFRRRLTVYSAMNYYLIKK

SEQ ID NO: 3030 - protein, 28 aa, Homo sapiens
KIHSIHRKRERFFRQLENQMGEFIKPRD

SEQ ID NO: 3031 - protein, 25 aa, Homo sapiens
KSNMKVSVIYLIPKKVFCKITFLSY

SEQ ID NO: 3032 - protein, 19 aa, Homo sapiens
KMSLMSGQKRPFKKWNYIN

SEQ ID NO: 3033 - protein, 19 aa, Homo sapiens
LEETMGNIGAITLRSRKSD

SEQ ID NO: 3034 - protein, 69 aa, Homo sapiens
KRLLVNPFRMATRGMFPTALPVPSITTSKWKVTGMFHLFPLRPAPLINHPMESYYYLQARMVAKKARES

SEQ ID NO: 3035 - protein, 58 aa, Homo sapiens
RERGLRAHTQFAGGGAHAAPPLPTALRQLRGRPADDTGRSPVQGPQDPWLPVSRRRPL

SEQ ID NO: 3036 - protein, 48 aa, Homo sapiens
AAIAPAPAPRTTTTTTIRSTTPCSRPVASCLPRPPRRAPAPSSGAKAL

SEQ ID NO: 3037 - protein, 120 aa, Homo sapiens
GCPAAPSARGRRGDPTVSARGGQGPGHQTHACLFQHQAERRWVGGAGGAGISGFPSDPVDQVLTLLIGRSRRCLPVPNFPGEGEMRGYLRLLVCLQWIQADEPEGYQNFTSSQSDLQKVH

SEQ ID NO: 3038 - protein, 181 aa, Homo sapiens
PSRRRSMSTTTTSTTMPSPRPRRRSRRRPRSGCTASALGAASITATRNAKATPRLRKPCPASSLAAAEAVPCPNAMGKARSRAWPCPPGKEGPPAELGPCSFPGRKETGRRMSGSGCWRVSGRASPSPIVPKAQKRPTPWSLPARLQANEPAGTICGGATAGTPAPPPVPTCSPRTLRCLP

SEQ ID NO: 3039 - protein, 75 aa, Homo sapiens
SWSWRAATAWRSACSRSERMKRERAPSSHSIRGRGRPRSTPSPYCPPAATRKTRRRYWTITCPGSSRPLAASLQA

SEQ ID NO: 3040 - protein, 69 aa, Homo sapiens
CPKHKKGLPLGVCPLVSRRTSQPAPSVGGQQRAPPHHPPCPPVHPGPCDASPDPTQHAGSAGGGLSQAS

SEQ ID NO: 3041 - protein, 165 aa, Homo sapiens
PPLPLPGPPPPPPFAVPLPAPARWQAASRGRLAGRLPPPRGQRLCDQADDEACPPPLHPPPCRPQDQGGDRGGGHAAGALLLPWGQRVLLLLEMQKPLQGSGNHAQRAVWRQQRQYLAQTQWERHGAGPGPARQGRRGPRRSWGPAASPGGRRQVAGCLAVDAGE

SEQ ID NO: 3042 - protein, 67 aa, Homo sapiens
LASRTPAAASVRMPRGPQCQGKKGRPHRVSQGWARARSPNPCLSLPTPGGTKMGWGSRRGGHLRIPL

SEQ ID NO: 3043 - protein, 57 aa, Homo sapiens
TATAAPTWSSSGPPITTSRPEGARCLCVPCPGGGEGGGVMLFSTGSRATPGVALGRL

SEQ ID NO: 3044 - protein, 44 aa, Homo sapiens
GTLTWVTPPSWPSGKGCRAWSWGPPATSTPGRLSSSPRCPGNGG

SEQ ID NO: 3045 - protein, 66 aa, Homo sapiens
TCPWACPWRLPPALPSCWPAAPPCTTSAGGTCTSPDSASSWAPPSSPRGSRCPGRSAQDRSRTLCS

SEQ ID NO: 3046 - protein, 49 aa, Homo sapiens
DLRLNLPMMSTAFLETMRAEGAHCLCPTDPRSDAAVTSAKPVGPHQCCR

SEQ ID NO: 3047 - protein, 47 aa, Homo sapiens
HLFLTVSHPTVTQKKFILEVQLKETVVTHLLEYSTLLVISSYPSWLW

SEQ ID NO: 3048 - protein, 45 aa, Homo sapiens
QSQTKRNMNKTEQKRKTKGKTARKAKNRASFLIYCLQPVKVIYLC

SEQ ID NO: 3049 - protein, 43 aa, Homo sapiens
KMETEMMIYSIKKIWLLIMLMRTQVQKKQMPLHPPPLHLHMIV

SEQ ID NO: 3050 - protein, 40 aa, Homo sapiens
TVLKKSKKKLRQLQRQRLNIQVLGEAELWASQRVLLKHPN

SEQ ID NO: 3051 - protein, 19 aa, Homo sapiens
ELKSRKNRCHFIHHLSTFI

SEQ ID NO: 3052 - protein, 88 aa, Homo sapiens
WQCCLPQDLRALSISQNSLLPSLNNALLKENQRNPKKKRKMMMKKPQSQAVTWKLANSCPSSMGTFLPAWCQSPWRTWTPTMQTKRLS

SEQ ID NO: 3053 - protein, 53 aa, Homo sapiens
NHYRTAFYPEKSTCSVDYRNFKNCDRKKFNVKLHSSLYHSFFLHSSIYKMSFS

SEQ ID NO: 3054 - protein, 42 aa, Homo sapiens
QKKENTQDCHYFIHICPQKIGAKKHNLSHLKTSLRLNKANRN

SEQ ID NO: 3055 - protein, 40 aa, Homo sapiens
ERLRSLQLPSKKALMLRVIVCSIQKNMEVLGLHLKPSRCV

SEQ ID NO: 3056 - protein, 117 aa, Homo sapiens
MASPGKKDQFHHLKTYHPLRFIQLLLEILTSTFCPHLLLFRRHLDLSHMQKHLVLVMAFLCFNLSLNKNSSPFSYIQEVFHKFPSGLCHNQERLGDYLTPSNLLCHREQHKLLQHPI

SEQ ID NO: 3057 - protein, 35 aa, Homo sapiens
VLFLSHYLITVKEVSHFLDLEQLETTSLMKFPLEQ

SEQ ID NO: 3058 - protein, 25 aa, Homo sapiens
DKERTVKKGKEEELRKSCKKKDVRN

SEQ ID NO: 3059 - protein, 23 aa, Homo sapiens
SAAYKKTWKCWACTSNQAGVCRV

SEQ ID NO: 3060 - protein, 59 aa, Homo sapiens
DRSPTNTSCTSMASVSATWRISWWKSLWKGVLWISSCTGKAMSLPHHGNSKLPNSWPVP

SEQ ID NO: 3061 - protein, 57 aa, Homo sapiens
GSISPIGMEPTTMSSQCGVILQRSRKMATRKKRFQMQPLSLMPAHWSICLLRDSMIW

SEQ ID NO: 3062 - protein, 34 aa, Homo sapiens
SGKNWKINTRRMRRKTRSGKSGTIFLTSLKSLTL

SEQ ID NO: 3063 - protein, 67 aa, Homo sapiens
ATWRIKTWSMEMCVLKTSSWPVRASTVSVAHSSSSVTPASPLRCCLGKNALNESHGLLLSVLRTPRT

SEQ ID NO: 3064 - protein, 66 aa, Homo sapiens
QAGQQENGTEALFPRGGLVLCVPGRWLLPAHSRCPSLPLHRRGPPVDRPQHTEWLSWSNLYRIRHQ

SEQ ID NO: 3065 - protein, 52 aa, Homo sapiens
RLLLLLLKNTLVQQDWWGCKTKKLELYLTLPCFPSHFFQHSLNQCTHFLIET

SEQ ID NO: 3066 - protein, 42 aa, Homo sapiens
LSLEKTTCLGEKKEATSNQDLLQMVPCSMQDPLLSLWTLFTE

SEQ ID NO: 3067 - protein, 41 aa, Homo sapiens
KILWFNRTGGAARQKSWSFTLPFHVSPPIFSSILSINVPIS

SEQ ID NO: 3068 - protein, 38 aa, Homo sapiens
INTGGFVRARTILRQVDFLAKAFHFLEPQLWIKRPWLI

SEQ ID NO: 3069 - protein, 71 aa, Homo sapiens
GTISQWSSSPRGPLKRGPLRKSVTSQRVVTLMMSVHQVAVTWKQPRALIWKVTLKVIKRNLKKMVKCSKTK

SEQ ID NO: 3070 - protein, 102 aa, Homo sapiens
RSSSTTSTSPRTRSRTGGHPPWTHPTPRSCSSSSSSSSCRSSTSSSSSTTTTRPSCLPRQSQQARPWEAAGPPQYAASPLPIAAPARAPLGPVGWHVRTAPH

SEQ ID NO: 3071 - protein, 97 aa, Homo sapiens
EVTAQQEGQGAEAKGEEAQVPPVHPPGPEAGQGGTPHGLILRQDPAAAAALPPAADPQPAAAAAPQLPGHPACPAKVSRRGPGKQRDPPSTQPLHYQ

SEQ ID NO: 3072 - protein, 94 aa, Homo sapiens
ASSPNSRKMVPQASRWTTCLTFSFRAEKFQQISRSRHPCQGRRSHPRRQSVGPPWQHSHHLLLSSPRLPHLLQAHPPSLDAWRTSWRAARGCPC

SEQ ID NO: 3073 - protein, 69 aa, Homo sapiens
PQKFQQISRSRHPCQGRRSHPRRQSVGPPWQHSHHLLLSSPRLPHLLQAHPPSLDAWRTSWRAARGCPC

SEQ ID NO: 3074 - protein, 37 aa, Homo sapiens
IKIGKRKTKKGNVNRIKEKRNKKGKKKILSSVVRMID

SEQ ID NO: 3075 - protein, 100 aa, Homo sapiens
CQMDKICLQWNLVQTIMGISKGIQTSTECGNQNGECISNPHTPLQISHGCHQHQAQWTLFLLLKTATVRTVGNLPLTTGIYLTRTITTLVDHPIILQWGQ

SEQ ID NO: 3076 - protein, 97 aa, Homo sapiens
NAGLFPLGFAKVLKKWNVKSRRNWRKKEWNNNVHNCPKKKKRPQKMLKEGMALVYLREVNLIVMRKKKTLKMLRLQVVGKSPEVHPQFLKKSTVTLR

SEQ ID NO: 3077 - protein, 88 aa, Homo sapiens
NQKKSIKKKKNKEGVGREVLVVVVPVAIAELVVLVVLSLALHTVLAQVVVVLLLGLLLLKGKRDTVGVDLQQSKLDVAGVEAILAELK

SEQ ID NO: 3078 - protein, 87 aa, Homo sapiens
DMILDRIVRKVLPKIVKNIQALILVEGAVLSLQEVAKKRRLRSLNIVDRDPWRNLKGLVRRQAANTSLSPDQGSILFKVFCLIFKKN

SEQ ID NO: 3079 - protein, 84 aa, Homo sapiens
DMILDRIVRKVLPKIVKNIQALILVEGAVLSLQEVAKKRRLRSLNIVDRDPWRNLKGLVRRQAANTSLSPDQDQQPLPVVNAEE

SEQ ID NO: 3080 - protein, 263 aa, Homo sapiens
AACSGGRWPAPPSGQGRFQLRGAGSPAPSPRPTPATGSGGGSSSSSSSSSSNSSLSSRKCYPRRAGSCGTTHWTSRCSREGCTSKSSGKEGRCLARPRCAAASSTCRSTGSGGSQPCPCPTWSCACRPSTGTTWTSTSASWPRSRACPTWRRPTCCCRPSCPRSPRLGPGRRAGPGTAPRGRPYPWPSPRSGPWCSTWRSAWQRELAPHWRWPYPPRPGIPGAASGWWKSVTLGPASCRRLTSSPWRSLLVPAAPPRETGRSS

SEQ ID NO: 3081 - protein, 112 aa, Homo sapiens
PSSYQGAVPDPGFPHAFPGHHEHAHGHLRAKQLPAQSVDSSQAGQTQGPAPHKARPEVPEESQKRPSDLILGLAGHQQCQQSGRGAQTLCRGASLREGASRTVCEGHHEGHS

SEQ ID NO: 3082 - protein, 134 aa, Homo sapiens
NRSYQESLKQTNFRYLLSHMHINQKPCTVKLGRKRIKSIRGKLHPGRASGQGTPCLSQNPTRRSPGFLWVQGVKLQNYQHLLIKTSLRKKRKSPVTGNMRHWPCLKDRKQAERPGLICRNPSLLWAWMMKLHNY

SEQ ID NO: 3083 - protein, 154 aa, Homo sapiens
DLLTKKSLRKKRRKSPITRNLRHWPCLKDHKWAVRLGLICRNPGLLWACMVKLQEYQHLLIKTSLRKKRKSPITRNLRQWPCLRASRVHTLKDHRWAVRLGLWKAVQLLKGSRNPTVQRRSLRKGSLRLSKGHECLVMIFQCPVRTLRAHSLIQ

SEQ ID NO: 3084 - protein, 55 aa, Homo sapiens
SIKRGKKKSIKKKLKVKRKNTKLRIVPKNCRGVWNLIENFGKRIFLKVMKLKISF

SEQ ID NO: 3085 - protein, 46 aa, Homo sapiens
KKNQNWKKTSKMINQPRKSMCQKRGTLKRNETRLKRKARNLLGRKK

SEQ ID NO: 3086 - protein, 27 aa, Homo sapiens
WRKKINNQIIVNTVNQKKAKIKKKTGS

SEQ ID NO: 3087 - protein, 51 aa, Homo sapiens
CPCGLVFWAPGHSRHDRDRPGGASEHQVMDLHQQDGRARGQCTHGQDPLLG

SEQ ID NO: 3088 - protein, 133 aa, Homo sapiens
SRSSWGGIRTPGHGSPPARWESPWPVHTRPRSSPGMNSEHSGSAGVVALSRLAMVQSHPMSLSLWPGPSRGHQRSSSLAFPPAGAPWVNSESGGRWRWTRATARPSPWGSHTAPSLGLSEPPPPSSGTSWGQP

SEQ ID NO: 3089 - protein, 44 aa, Homo sapiens
ASRSLRPRDARPPCLPPQLRVPEETGPQLTMMTQRPISITRNTR

SEQ ID NO: 3090 - protein, 65 aa, Homo sapiens
TTGRTVASTPMRLSPLSSPTQGAWWQWLLPGTPPEQRREKGLSSPKHGFGIVSTSVTHLVRGHSV

SEQ ID NO: 3091 - protein, 44 aa, Homo sapiens
RCPARPTSPARAPSGPCTLTRATCSRTAATCAARSASSARSSWR

SEQ ID NO: 3092 - protein, 122 aa, Homo sapiens
LGQHVRERLLPAPPEALQVREAAGAEGGRRRRRQRQEGGRRSPGLTGSTRGGRRAGLRDSGGHRVASLERLPVPGAQARGPGRAEGDAGCGAEPPRAGALSRAAAAGRGPPAGPAPPPGPAA

SEQ ID NO: 3093 - protein, 37 aa, Homo sapiens
AAPATPRPTGAATRTQSRPTRTSRSSPWPSSRAPTRC

SEQ ID NO: 3094 - protein, 115 aa, Homo sapiens
GPPEAGTPLRLQPPVLHQQPHVLGAAAPPQPPPPPTPQNGPQGLRTGDALPRLRFPHAWQLGHGPGHEQNGPGRLAPGRRYLLLPGGVLPAHYELLLRRRRLQARLTLAPRIEDK

SEQ ID NO: 3095 - protein, 59 aa, Homo sapiens
SGKRPPRRASASLPAPWTRTPPCSASEAASPRTCCGSTAHSPCSSSSATSPGRTHRGWA

SEQ ID NO: 3096 - protein, 55 aa, Homo sapiens
WRRTSTSSSSGGPWRCSPRRSCASSSSLPATRSASRSPAPAKMGVPTLPMCPRTP

SEQ ID NO: 3097 - protein, 54 aa, Homo sapiens
WPCSRSSTSCTTRRRRTGSQAAPAGAPGGRRPVTRAGSLRIFMHSWKGAWLWPK

SEQ ID NO: 3098 - protein, 112 aa, Homo sapiens
ASAPPPPPARPPSAARRASPKPSATSLWIRCLPASSCPSLRACWSPTRCPARKAWTFPCAAPAAWAAWAAWGSPWTMQRRPRCRTWAPCTQSLPWTTSPSPPAPSKASQSWR

SEQ ID NO: 3099 - protein, 209 aa, Homo sapiens
QPQQALLQVHLPDHDGRGGGAVQPGPAHPCGVGEQGHLRGSHPEPAAAGAAECGVRDGRAGRPGLHHPPAAADHAQPTGDGAAHLRPPLHQPRVPQGPHHVPSGADGDGPAHRVLLGGPGDVHPGGAVQVHQVCLQPGAHPVHLPLQRWGSRHCPCAPVPHEDRPPRWHSRFPRLSLHPRGDLHVHDQASPVLLSGNHAGETSLCHSLP

SEQ ID NO: 3100 - protein, 24 aa, Homo sapiens
RSPPQMAQQVPQTLATSAWRPACS

SEQ ID NO: 3101 - protein, 46 aa, Homo sapiens
RGGKRLWERARGGRRRGGRGGRQTRARAGGGGARGGGGGHGGRGPG

SEQ ID NO: 3102 - protein, 46 aa, Homo sapiens
RTAPGCSIRPRLPRFRTRTPPSTRMASTSSGTRPVPRTPPGRAPAR

SEQ ID NO: 3103 - protein, 32 aa, Homo sapiens
SWRRRSSGGRRRTRGARAWLTTTRTRRSIWRT

SEQ ID NO: 3104 - protein, 95 aa, Homo sapiens
AEGQPRGAASGRGCRVSAPAPRLLPVWPVPVRGPVPSQERHQGEHQHAEGLAQRAPQEPLPHQGREDHAGHHHQDDPHPGVHLVRQRAPAPQEGE

SEQ ID NO: 3105 - protein, 149 aa, Homo sapiens
PWWHCSLAIGTGKKARSTTTWLWLTAAGAWTAPSMSCQMSLRATVTTTPTPATTPCRSAPQTPHPLTRFQARSLPACRTLSGQVGPKGMITTPPCLLTGSTAGSPLQGLWTGGAAAWTEATAIATAMAQAHSTIKGSSLKRSSGPVWLP

SEQ ID NO: 3106 - protein, 295 aa, Homo sapiens
RRTTASACSAAMASMRAGGSVSRSVPRSVSMAVVWHPISANVCQAGGATTVPVSVPQECGGHSVTSPAAAATTARVIPRVGYVLALLVCSPRTAFSPVPLATMALPASSAASAMGHPAIPRLEPASAPQRELGPAVTCPVPRALLASSAPAPILAKMEVSSKPHRAPAAAPLAGWAPSAPCPAQRAFTDPTAPRNVAATTAASVTDSLGSAAALRVTLGIGAGRSARWAALGRTVLRRATAPRTPVASRPTAHVCANTASLGTAARIASAPTASTVSAARPPAPATGSTASAATR

SEQ ID NO: 3107 - protein, 38 aa, Homo sapiens
KALPQDLPPGSLLSSGTARGGGNPSHRETVAPTSSPAP

SEQ ID NO: 3108 - protein, 75 aa, Homo sapiens
SMTETLWAPSPLCLRAYPPATMTHPRTATSLDIMTCLQYGIPHHLHFDARTVEEPGWYGRGQHTWLLLLKAGDRA

SEQ ID NO: 3109 - protein, 26 aa, Homo sapiens
KNSPEGANCLSEERICSTFLLHTMHH

SEQ ID NO: 3110 - protein, 86 aa, Homo sapiens
VMNYVTQNVHPKYKKLKVNHEVLKNLVVQILSVWKTVKKMWHSVIHASCSAKNILAVEESHLQPTELLIGKKPWKNSESMKKVKCI

SEQ ID NO: 3111 - protein, 69 aa, Homo sapiens
IKCFLQFQPQLFRFPVLVVKKFSRRGKLLIRGKDLLNFSAPYHASLNTFHLPVHQFLLRELVQTAQKTF

SEQ ID NO: 3112 - protein, 67 aa, Homo sapiens
CFLQFQPQLFRFPVLVVKKFSRRGKLLIRGKDLLNFSAPYHASLNTFHLPVHQFLLRELVQTAQKTF

SEQ ID NO: 3113 - protein, 55 aa, Homo sapiens
VSPVPNLLQLPQALPQVTLPQLKSGKYVQSVMSFFLKMSIVCTSKKNIKLRKSQQ

SEQ ID NO: 3114 - protein, 53 aa, Homo sapiens
NGRIVPMEKLKGFGLRTSHSGRMHLRMMSAYLTPRLSGRIAQLTVRMGNSLTT

SEQ ID NO: 3115 - protein, 43 aa, Homo sapiens
KDPYLMHLHITYERGTKLFRRFIQLRKSSPTNVSIALVCIPAT

SEQ ID NO: 3116 - protein, 34 aa, Homo sapiens
NQEPGLTSLPKAKMQGAVSQLPKKRLPCKVTESS

SEQ ID NO: 3117 - protein, 20 aa, Homo sapiens
KRCWENPLSSLLFNPKRTHI

SEQ ID NO: 3118 - protein, 15 aa, Homo sapiens
KKYLVTLGWNTVKNI

SEQ ID NO: 3119 - protein, 42 aa, Homo sapiens
HEPAGYFHRDGEEGHPGRRKVGHPEKSLCPNQQEPAEDNQRL

SEQ ID NO: 3120 - protein, 29 aa, Homo sapiens
LCFLPKPCRGNLVHPVTLPEPERAMSSRR

SEQ ID NO: 3121 - protein, 23 aa, Homo sapiens
QEKHGETDASAYFHTKKKTCLPF

SEQ ID NO: 3122 - protein, 22 aa, Homo sapiens
RIQQRGGVVWGNDNLGLSKRTG

SEQ ID NO: 3123 - protein, 21 aa, Homo sapiens
IFKWGGVVWGNDNLGLSKRTG

SEQ ID NO: 3124 - protein, 74 aa, Homo sapiens
EKNLSSLLIDGAILFVLFCFVFLRQNLALSPRLECSGVISAHRKLRLPGSGHSPASASRVAGTTGARHHTWLIF

SEQ ID NO: 3125 - protein, 112 aa, Homo sapiens
HWRSTGGCWTWTRRRTSTATSRPTPAPPWSPPQPRPPRDAAGFSVSVRDSREEPGGSSPRGAMLRAGLSSVTIPACNISVNSEMDLGPLTPRTQPWARARGGRRSAERARRK

SEQ ID NO: 3126 - protein, 31 aa, Homo sapiens
SWLGGPALRQRCQRMQPGERGLPPDLPQQAG

SEQ ID NO: 3127 - protein, 104 aa, Homo sapiens
TASTSMGLRTPKTQASPPACKTCLTSARPTPAIGRGPKPARTSWATSSACVKLAGGAGSATKMSTNAARRTGAASRSATTSRVASTVPATAASSSPLMAGPAKT

SEQ ID NO: 3128 - protein, 140 aa, Homo sapiens
SLSKDFIAQSLGRRVNGSVKFVTNSQRSSLTFQTQHKKVTLSSSEDLRMRWKNAQNTCRRWWQIWWKIAIQFLFRSSNSFTRISLGKEAQTLKRFVKKATPKSTFQQRIAIQRPLSSQASEPTAKLPGAGFCLFRKTWPT

SEQ ID NO: 3129 - protein, 48 aa, Homo sapiens
AALRNFPALGLRWLPRPSLGAPNDNDQKEQNPLQPADPNPTTQWFVSI

SEQ ID NO: 3130 - protein, 48 aa, Homo sapiens
KLQPKSRSHAQMTPAIRSRSLAPKRASRKLAMKSYSSLPSRTNVLWRG

SEQ ID NO: 3131 - protein, 35 aa, Homo sapiens
HPRQARIPQIPHRQGGRQNSQGARQHWSTCHLPCG

SEQ ID NO: 3132 - protein, 97 aa, Homo sapiens
SAPSWRSAAGSTFTFPWKVQEATPLLSGALPRMWRRPRSSSCIWRRRSKPRVSLLTSAPSQNTTNSSSARGAAKFARCATALEHVSSSLRLRTRTRT

SEQ ID NO: 3133 - protein, 91 aa, Homo sapiens
TGQRLSSLERRNSWLRLWLASRRFMRRRPIASPSPLSPPLPGFTVSSLARKGRTWPKSLSRCQRFTSSSQRAKTRSPWRALQRMSMWPRNR

SEQ ID NO: 3134 - protein, 69 aa, Homo sapiens
LKSMPRPIASPSPLSPPLPGFTVSSLARKGRTWPKSLSRCQRFTSSSQRAKTRSPWRALQRMSMWPRNR

SEQ ID NO: 3135 - protein, 152 aa, Homo sapiens
WSTACWRRRPPGRSRPPSWPKPPHSRLPSGCLPLAPTWPLATATPWNMTLRAPPAPPRRPAVRHSDCLQPPPGGPLSGTWGTLRAPSSFHPLVATQALLSQRGHPRTALGGSQPLSATPSRVLPPRRAAAPTQQLPHALLAPSLQDLAKRPP

SEQ ID NO: 3136 - protein, 56 aa, Homo sapiens
DCGPGPVSDTGLPGVSPASCPGHLEQRRSPPGEQQPCPHLCHPQELPASDHPGGGG

SEQ ID NO: 3137 - protein, 125 aa, Homo sapiens
RDCWAPRRQAPPQGTSLALAPAPGGHPHSRKPAPSPQSPELRRHLPCPRGCHSPSSTKAQSRSRRPLPEPRNGLCPFGWRVQPGPGQAQGSCSGTSTATWSERPHRGPTHTRPSTRTPHGPHPCR

SEQ ID NO: 3138 - protein, 36 aa, Homo sapiens
GRTGLCASCRSVAWLWQMLGSTPVCVGRRGPLPLSP

SEQ ID NO: 3139 - protein, 100 aa, Homo sapiens
KTRRSGPAHRHASPARSARRCPWERRPGTSMARQCSRMTATGLSPPTAVTTPYCCAAPSPTTPGRSPSLAATPWPLRGSPCWASLIPQRMLRWWLAAATL

SEQ ID NO: 3140 - protein, 87 aa, Homo sapiens
PCAMSRPTTTRCTSARRQRAAARWRSSQSKETSSESSLGRRRCAWATRLCFAWSWRSRWAPSTGCGTRRKWWRGAAWPSPRRARATH

SEQ ID NO: 3141 - protein, 79 aa, Homo sapiens
GLSRMPSRCGKASMWRSWMQPTHCAGLSAPSPPSPAPHGRAGCHQPTWTGGSSCHLSGGPLRPLSSLGRLCLKTNTRQG

SEQ ID NO: 3142 - protein, 78 aa, Homo sapiens
VPARKCAWRPWAAHGGWWCSRRARQRPGSTAARQGVSSSPSACRWQSPRRCLPRSRWCLPRISRCTGRCRLRQGPAPC

SEQ ID NO: 3143 - protein, 71 aa, Homo sapiens
ASARKCAWRLWAAHGGWWCSRRARRSPGSTAARRGASGSPSTCTWQSPRRCLPRSSQRAGRCRLRRGPVPR

SEQ ID NO: 3144 - protein, 71 aa, Homo sapiens
VPARKCAWRPWAAHGGWWCSRRARQRPGSTAARQGVSSSPSACRWQSWSPKFQRDPAAGSLWWSRSMKTSS

SEQ ID NO: 3145 - protein, 67 aa, Homo sapiens
KCMWRLQAVHGGWWCSRQARQTPESIAVRLGASSSPSACKWQSPRRCLPRSSQRAGRCRLRRGPVPR

SEQ ID NO: 3146 - protein, 64 aa, Homo sapiens
GAGIGRAAGAPCARCGPGRCRPLRVRQPRGPHRLPALRARPRALSAQGHGGQLCGCRGWGPGAV

SEQ ID NO: 3147 - protein, 101 aa, Homo sapiens
RSLHHPQLPWWITWLHPTLLKMTSEPPKWGLQPLHSLAVLCPSEASVCRGAWRARYPQATALEVEGAPSHSVDSHPPSLPILWALLSTCPPRVLATHPQAT

SEQ ID NO: 3148 - protein, 94 aa, Homo sapiens
LRSPQSGGCSPSIPWQSCALRRLPCAGGHGGPGTPRLQHWRWRGPPATPSTATPLPSQSYGPCFQHAPPGSWLPTPRQHELSQPTLQPASGSKL

SEQ ID NO: 3149 - protein, 84 aa, Homo sapiens
SKKKKKLKKRYFRSQQRKNEMAEKRNILVPRRLVQNLVNEGHVRKKEKTGNGETMTGTMSGMNCTVRSMTGEEAGVRVGVRVEA

SEQ ID NO: 3150 - protein, 64 aa, Homo sapiens
KKTGSNEVTTRYEEKKTGSVRKANRMPKDVNIQVRKKQKHETRRKSKYNEDFERAWREDLTIKR

SEQ ID NO: 3151 - protein, 138 aa, Homo sapiens
LGLWSASSTALWTRSARRVGSPATTSRGCMSWCQTLSRCTSRPWRPCSGRAGGCRPSRSPSCCGRACCRVRSVCWTACASTCCRMGVRRARGAVLGDQHCSQLRAPSSSPRTGSSSRGCPRTPWLGSRWWSAPSRWLR

SEQ ID NO: 3152 - protein, 112 aa, Homo sapiens
KWPLTRRWGLTAPSSSVSSCISCGTRRTSGPPLRSPWALPTHLAGHRESPRTRVLPSEPCPGTWSRTPRRPSGGSMSLARSTTPPAGSTGASRPLRTRRTRSQCRRSWSPAR

SEQ ID NO: 3153 - protein, 15 aa, Homo sapiens
GGRGGQCWGTSIAPS

SEQ ID NO: 3154 - protein, 73 aa, Homo sapiens
AAVPAGHQGHLCVHLGLCPHTWPATASHQGQGSFPQNPVPEPGQERQEDHRAAACHSQEVQPPQLGAPGPAAP

SEQ ID NO: 3155 - protein, 144 aa, Homo sapiens
ESTVEKSLTFVVFVGKVFVMEVRIDFTYEYIMMIKDMSAMNVEKHLSVMITLQSTKKYIQVKKLISVKNVENVLVVGIISLFITKAYTLERKCGKNIKQHFINVMFVRKFLKANQVWKCIFERIQVKNHTSVKFAISLLELRKH

SEQ ID NO: 3156 - protein, 30 aa, Homo sapiens
VPFIREKTWVKNAGEKFLRKKIKKESEVPC

SEQ ID NO: 3157 - protein, 24 aa, Homo sapiens
LQWSFRTATKKYCSVLNVIKHLTE

SEQ ID NO: 3158 - protein, 151 aa, Homo sapiens
SPGGGGRSGGPATWSSGRPRPRAARARPSPRRRPPGASTCPRGGAAGSCGCPSGTRPATARRRETATAAGTAPTARTTSPQTSATGRTSTTERGMRSRRGPRRAQRPCRTSMSRPPCPRSSAPAARAGGMASPRLHLRDWLLGWKQGKAWR

SEQ ID NO: 3159 - protein, 46 aa, Homo sapiens
RRPLQGSTSSMTVSGTSPWPTWCFHPPRSLRPAPRCTPSQTMSWRT

SEQ ID NO: 3160 - protein, 44 aa, Homo sapiens
CRTSMSRPPCPRSSAPAARAGGMASPRLHLRDWLLGWKQGKAWR

SEQ ID NO: 3161 - protein, 90 aa, Homo sapiens
WSRSATGACRACPGSTPSTATSATGRTSTTERGMRSRRGPRRAQRPCRTSMSRPPCPRSSAPAARAGGMASPRLHLRDWLLGWKQGKAWR

SEQ ID NO: 3162 - protein, 77 aa, Homo sapiens
DPQKWRAKHTSPRLRTSGPMTSWRRSRSSSTTCSTPPFPSQNSSGTHCTSPPTCSPRQGGCGRVVEPAPPAWGPTQT

SEQ ID NO: 3163 - protein, 61 aa, Homo sapiens
RHGAGPGPPLLPAAPPHFLRRTQAEHTVLLHRRVARGRVAAGGWWNQPLQPGVQLRLERLQ

SEQ ID NO: 3164 - protein, 44 aa, Homo sapiens
KTAGQRPRGAWPAWQKMAPPRTPRPACVARRTQRTRSWKPRPAT

SEQ ID NO: 3165 - protein, 114 aa, Homo sapiens
TRKQPAKGQGGPGQPGKRWLHRGHRVQLVWRGGHRGRGAGSRGQPPEQRLIPGAPWWCPRQLGSSRKPRVGRQTSGPGVPAGPPPHCSQPGHLRLHPRMHLLSEQRPQRCFRRR

SEQ ID NO: 3166 - protein, 28 aa, Homo sapiens
SSLNKSCQKNWRRLKVKYPVTRMQLRLN

SEQ ID NO: 3167 - protein, 27 aa, Homo sapiens
VHEDRPGGGVRPPLVHSWAEEAADEAA

SEQ ID NO: 3168 - protein, 21 aa, Homo sapiens
RSTWRRSATPPRTQLGRGSCG

SEQ ID NO: 3169 - protein, 138 aa, Homo sapiens
SWRCSSLARPTGTSRAVTWRARAAATRRPRCRRRETTPWAQMGTARPTARPRAAAPEIRRATANRVREAGRARRRRSRQQLLQRWWRRARRPGRRGQARAARGAARVHAASHIRGGPSPPTRTSRSSPWPSATRRAGA

SEQ ID NO: 3170 - protein, 261 aa, Homo sapiens
RWRRSTSTSWASSPFSAAATRAGATPCATTFRSTTASSRCCATPRGPGARTTTGCSTPTASTPSPTGSSAAAASASATARRSPRPGCGPRRPRASPPPRRPRPPPRPRPACARPPARRSAPAPRASSPAPSPSTASCASPSAAAASGTRPPGRRFSGAPRPARRCPRSPRSSPRRPAGPCCRSARTARASRRGWARARPRCHRPRRPSCLHLSRRRPPPSHSEARRPAARTCTAPCGCPQPCRRPQSAALARTCRTRWRRS

SEQ ID NO: 3171 - protein, 428 aa, Homo sapiens
PGGRGRQRRAVPAVGGGRRLPGLRWGLRGQQPGRGRRRQRYAGRRRTECGRRAGRGGGDPGSSCCSGGGGGRGGRGGGARRGRRGERRGCTQQAIYAAAQAPLLVHRAHRHGHPRLGGRALDAGGDQRVPHGQVPLFPRQLHGLAQLRAPQPFAQRLLRQGAARPLAALGQGQLLDAQPQQRVHLRRRGLPPPPQAPQPPRAGPRARAAARGGPGPPRRPAARARRPGLAPHALARPPGGARQPRGQVLQLLRHRQHPAQALPQPPPQGHGPRDDASVGRRALPAAARVPRAPPRGALQGPAAALRVRRGRAGAAGRARGRGATDRAAPPACTSPGGGPRQATPRPGGRRRAPVLPPAAARSPAGGLSPPPWPAPAVPGGDAPSLSSAAGPGNAECAPSGRRERGPARGLCTLNPEEDEFLKSPSNVP

SEQ ID NO: 3172 - protein, 60 aa, Homo sapiens
KTEKTPTSREKTPRPDPWRGLPVRTAPPRGRHLLLTAPGAPRGAPAGPVRMGRPTPRAPR

SEQ ID NO: 3173 - protein, 52 aa, Homo sapiens
SAFSPGPFGSSFCTRGVTFFRWWRTFRGCATWGCYSLVPRKSFRIKIRSLSS

SEQ ID NO: 3174 - protein, 50 aa, Homo sapiens
AARRSLQRALKTPEGSQRVSELPTSPRQHGKGTVRVSASSAGRGVSWMAT

SEQ ID NO: 3175 - protein, 49 aa, Homo sapiens
GILTLKSQTHSRSCSPGTEFWQLGMKKIKPGKRMNLTAWMTSTFWCFRT

SEQ ID NO: 3176 - protein, 101 aa, Homo sapiens
SRSQAGQASGRPPLEVPGRPALKPHLKAAKMVSPGRLKWSLPRRQCMSTMPRGCATSPQSQSTGTSALAGLSSATSSSAFPSPSSSRLCKSATRWTTWRNF

SEQ ID NO: 3177 - protein, 88 aa, Homo sapiens
PLPRGQRSRTQIWPPALGPELKMGQKPRPHLHPQLLKTPLQREQHRKTKRVSGSQRVSELPTSPRQHGKGTVRVSASSAGRGVSWMAT

SEQ ID NO: 3178 - protein, 80 aa, Homo sapiens
NPSGYECGKTRSKNAVPTSSKIQSCQGIHGRRRSAANHQVHFLRVCRGERPKPAVPKREGPQRALDHREPGVYAGGVASA

SEQ ID NO: 3179 - protein, 65 aa, Homo sapiens
CWEAALSQKNFEQKRADYNAVPCDPITHWSPATLNPPPTEPVSCGQEEQIRHPHGEAFGHAEHTD

SEQ ID NO: 3180 - protein, 62 aa, Homo sapiens
PLPRGQRSRTQIWPPALGPELKMGQKPRPHLHPQLLKTPLQREQHRKTKRVSVSSVPQAKSS

SEQ ID NO: 3181 - protein, 35 aa, Homo sapiens
GRAWCPGAPLPPPGLGCLPRAGPPHPSLGSPGKCV

SEQ ID NO: 3182 - protein, 92 aa, Homo sapiens
WLWHGPLPRRLDSLLARLGSASSLLRLARHPKVGHGAPGPHCHRQVWGACRGQDPPTLPWGALESVCECAQLQARGVDGEDQRWIRGGVWQT

SEQ ID NO: 3183 - protein, 54 aa, Homo sapiens
HLHLQCQHFHSTWRYTTFCLGIQFYLSGLPAPQATKHPSAGRPNCGPPLLACGQ

SEQ ID NO: 3184 - protein, 35 aa, Homo sapiens
IYGFPGQLPIETLPLGYMMGTKRQLYSNVIFLLRP

SEQ ID NO: 3185 - protein, 25 aa, Homo sapiens
PYFGAPQITCTCTSMSWPLYSAETY

SEQ ID NO: 3186 - protein, 87 aa, Homo sapiens
SKGKKGQSDLFQPPSCQLDSLGFFWSKLASCVKYVFGCLTSSNPSLNSNPVLYIFPIRLDSLIAECCPLCFYVLGAQCSVLYKINVC

SEQ ID NO: 3187 - protein, 84 aa, Homo sapiens
RLAPSAFFGSRMSVLSFSNTSKQWKLITCGFPANSLAMIFHTMWHCALEKCVSERTYRKFLTCLPHSPRALGWIKRNCPSAHPY

SEQ ID NO: 3188 - protein, 58 aa, Homo sapiens
CPRRCPSRSTRSSRPRAARRAAPRPPWLRSRPTWESRAGSLEDPMRRSSRSARRLKRP

SEQ ID NO: 3189 - protein, 78 aa, Homo sapiens
RRLLHPTLQPPHPPNYSMVLQRLLHPPSSPPPRPPWALMSPRALLTQPPTLGCSMQMRRRSQRRRRYRSCALSYGRRK

SEQ ID NO: 3190 - protein, 77 aa, Homo sapiens
RKRTLRPRQSFREPLMPQKPHPKNFGSRDKTPQIASQASTASLAIPASAAARMLMRKRRKKRVGSMSFEVPSTKRSV

SEQ ID NO: 3191 - protein, 12 aa, Homo sapiens
KRGPSQLPHTRI

SEQ ID NO: 3192 - protein, 74 aa, Homo sapiens
RKRTLRPRQSFREPLMPQKPHPKNFGSRDKTPQIASQASTASLAIPASAAARMLMRKRRKKRVGFEVPSTKRSV

SEQ ID NO: 3193 - protein, 71 aa, Homo sapiens
CEKEEKKELASKFLQQSVQYKKGAQVSFLILGYRGDCYTRLFSPLIPQTTAWFYRDCFTLHQVLHLVLRGH

SEQ ID NO: 3194 - protein, 62 aa, Homo sapiens
ASKFLQQSVQYKKGAQVSFLILGYRGDCYTRLFSPLIPQTTAWFYRDCFTLHQVLHLVLRGH

SEQ ID NO: 3195 - protein, 154 aa, Homo sapiens
RHPGRRPGLLLPNAVQYLLPGNHQEHLCGKASASPRGVPGPSGSSHAGGVPGAAAERVQRLLRVHHQVSAGAGHPGAPQQCGGDVSRHPGAGAAHGRHWGAGRVRCPLHRDAACHRDHAAHAMQLPAPMVGARARGTPFRPARRRPPTLHSCHL

SEQ ID NO: 3196 - protein, 113 aa, Homo sapiens
AQAQPAARAADLAHVHRCQVPDLEVRGHLHRQLLPVPGLVYGDVPLGTLQQLLLCCPSPGHRHGGQDAAHHPVLCHPQWETAGDDRGPSGGGRLPVHRGGLQLLPQVLQQERG

SEQ ID NO: 3197 - protein, 33 aa, Homo sapiens
PFPLLTVMTSADLSTMRGELCALMPAPSGGWSH

SEQ ID NO: 3198 - protein, 109 aa, Homo sapiens
TSTTPAPCTPPSLRGSGPSWGSPTVWRRCVPTSRCWSGSWQTLGGWPSQVPATQRCRMSSRSRCPCYAATCPDGGSAGPRHPLPPCPPAPPHPAQLSPLTTSTPCWGIS

SEQ ID NO: 3199 - protein, 103 aa, Homo sapiens
RRPGRVRRRRRKRKKRGRYHKVPRPMILEKATTLSPPTLVLLPCPGSCRPWQNNWQKITTTRGDGRRSRSWKPKAVGPTPCWSPTTRSRPRRRHEIERRPRSY

SEQ ID NO: 3200 - protein, 194 aa, Homo sapiens
TATCAWPCCRSSPSVRRSLRAQNTAPSWWTLCCIPCTACLGVVRSPRRSVTSSRTASCRSAGTSARRCCSTCCAAWCSTCPSSTSSPRCHSSSSPTTMSAVGSTTAYPRAGPTSGSPQRRSCTSHGNSSGASLTLWPIRNTTRSCTAWPCLVCAPLPGLCPPTMWMPHTHLRQRKRPQWMLKATLIPGLWRPSM

SEQ ID NO: 3201 - protein, 20 aa, Homo sapiens
RITFFSKRQLLPVSLIEAQI

SEQ ID NO: 3202 - protein, 86 aa, Homo sapiens
KLRSQNEEKRMVNVLAAYTARKGLIMKKMLGENVRMLQTLLKDAYIKLVACSVQRACCIIVCQTQREIFLIPVRVTLATTSSACDG

SEQ ID NO: 3203 - protein, 80 aa, Homo sapiens
AASLSSKSLIRKRMAVLTFLSVESDSGTKWWFWNVCLKKTSFIIRSLQHFTTGRLMTRSLVLRFKVLLMLGLLIEVSEEL

SEQ ID NO: 3204 - protein, 84 aa, Homo sapiens
GGWDWAPRCPRRLPMSFSRRGGSAHTSRSVLSVPAGILPSSRGMGRRPRPRRAWKHSPLLRPRGGAWKSIFRLYSRAVLVERGP

SEQ ID NO: 3205 - protein, 73 aa, Homo sapiens
LSRSSSATAQAGWCLTQPQSAGTGARNPRPVVTGTRMRATAFSAGSQTIASQRLTGLLRLSRMICGLTLYATT

SEQ ID NO: 3206 - protein, 27 aa, Homo sapiens
CVWQGFYPKFKSCGTSENSHWRKTLQM

SEQ ID NO: 3207 - protein, 367 aa, Homo sapiens
NTLYYIHSMGEHTLEKNHTSVMTVERLLAKVRTSLIIREFTLDRDLTNVTSVAKPLTSVRTSLGIRESIQERNHINVIYVARSVVKIQILQVIRGCILERNLTNVMNVVRHLSSVHTFGVMKEFILERNLTNVMNVTKPLLNVQALPNIRESILERSLTYVMSVAKLLSSAHISLGIRIYILERNHTNVMCVAGLLSKVQVLWNIREFTLEKNLTNVINVIKLLSNVHTFGVIRELILERNLTNVLNVAKPLLNVQILLSIRKSILERNLTNVLNVAKLLPNLQTSLDTRKYTLKRNIVNIIYMVMLYSKVQTLEIIKKVIIEKNISNIMRQKLSIQAVPSIRGSIVKRNHIKRKCGKAFSYGLCLT

SEQ ID NO: 3208 - protein, 59 aa, Homo sapiens
WFLLLTNPDKRSDTLHWGGCPLSLWKRLKVFSRDGLSEDQVLHRLTVGKSHLLEFQTPL

SEQ ID NO: 3209 - protein, 40 aa, Homo sapiens
TQSVVPSAIWQNREPPAAGQFIMGLWEISPQIILLGALLL

SEQ ID NO: 3210 - protein, 38 aa, Homo sapiens
NQLHLWRKRSPRCVRAPSAPVAQLAAQKQRNNTVMQAS

SEQ ID NO: 3211 - protein, 31 aa, Homo sapiens
AGMKRCIFSMFPSLMDISYHHCWQDFICFGP

SEQ ID NO: 3212 - protein, 131 aa, Homo sapiens
WSARAGMDTRGPGQARGSWVRRPRPKPGLITICRCRKMTGGVTPPVARMGRSPAAGCGAAATSKPWGMRRAETQTAAPRHLPKQSPDASPPVAPPAWTRPGSTAVSHPGSTPGAPSLATAVPSPLDSSAMS

SEQ ID NO: 3213 - protein, 227 aa, Homo sapiens
ALREGQRGPGLGGVAAPSPGCTLARAPSTPVKTVWATHRARVPPACLLHSWISLKSSCQFNKMASTHYHTSEGQQGQGPGQRQGRALPQSPAVRALAASGTWFILCRSSLPSPTLWRRRGSGTIMGPRLREEVALEETATPARALEAPTPPITTITTTITTTTSPGTARGARARTARGMGGTRPSPQAGGVPMTTWTVIAASWRVGGPLGSLVVPSAWRVQMGPTGT

SEQ ID NO: 3214 - protein, 16 aa, Homo sapiens
QHLPQDVPWPGPLRHL

SEQ ID NO: 3215 - protein, 49 aa, Homo sapiens
PRSMGSATPTSSTSTGSPRPSSPTPRSHLCTSTPQTSRTWAPITPTHRR

SEQ ID NO: 3216 - protein, 47 aa, Homo sapiens
CMLETQIYHMSPPGDQPGPVTATPRPSRKLLNHLLPQCPKLKTSVLS

SEQ ID NO: 3217 - protein, 90 aa, Homo sapiens
QEHHDQGPWEALRLQVRLPRDRPGPPAPPPGVISVQVPLRPPVHGLLSRPPTEDELCGAPPSSPPRDIFQFFCCPKPILEFTNWGYIPQH

SEQ ID NO: 3218 - protein, 71 aa, Homo sapiens
CMLETQGVQLLFSQILQYILKLRKELQLGQIYHMSPPGDQPGPVTATPRPSRKLLNHLLPQCPKLKTSVLS

SEQ ID NO: 3219 - protein, 63 aa, Homo sapiens
HLPVFLLPQTHTGIHQLGVYTPTLGSPPAICLLIWALTTKDLAEAFPISVHSPAHRHKLYRRT

SEQ ID NO: 3220 - protein, 53 aa, Homo sapiens
AKAISARVQGGLRGGVSLPPPPLQRLQGHLGRPYPPCHLLRCGHRPLQCLFLG

SEQ ID NO: 3221 - protein, 30 aa, Homo sapiens
DLPYCPPTPQSLTLWDPLQCQRPHPQPQAS

SEQ ID NO: 3222 - protein, 84 aa, Homo sapiens
RPIITCLSQSHQCPSTRWPPWGGLAASSSTTASPRPSGTALSSLPPSTLRSPSPTMSVSRVTMTPPSLRDTPLSATSPWKCSSS

SEQ ID NO: 3223 - protein, 160 aa, Homo sapiens
GSILSMGLPSGLACPGTSPSTCARALTPVASAAFPDPLASPSPAQKASAPPQTRRCHPSQRPRVARSLGVVPGPDGPSCCPTSAQHGLGAPWSAFWARSCPHSQPLSPLLPYPHPCPLPWLARATVPPLTAPPGALLPGSPLSFSFPHWEPLDLRTSVPG

SEQ ID NO: 3224 - protein, 130 aa, Homo sapiens
KNLAQFQCPCILVLSLEAPVAALHLVVLLLHHPFQICSIFRKKTYLPHHWVLPTIYKFPKILPVLVARTLLVTRMTLFWCHTTSRQTTHVICQWGLLADVLQMNSWCVEGSVSLLCHLTAKQHQFQFLLK

SEQ ID NO: 3225 - protein, 43 aa, Homo sapiens
CLVFPEKHHLIWLISFWVCFRETKKIEWTLKHFLAILFLSKVQ

SEQ ID NO: 3226 - protein, 69 aa, Homo sapiens
ARSSKKILPSSSAHVFWFCLWKLLWQLSILSFCFSTIPSRYAAYSGRKLIFPTIGSSQLSTSFQRFCQY

SEQ ID NO: 3227 - protein, 146 aa, Homo sapiens
RDPRATWEQEAFLDSLVPMEFLDTRGKVGPGEGRATMAATEPRETQVHRGPPALRGSPGLPGPKDQKGRKVSLMHCLKRSATDIGVNLESLDWSVSRDLPAALGMWDRWVQLELQGDQDHLDPLDQKDSKATEDLVSTELRVKRVT

SEQ ID NO: 3228 - protein, 103 aa, Homo sapiens
TRLHGEHWTHRGGGRQRPQGTQGRPRIPWCPRDCGSPRDCRNPPEDCRPTRDSGSPGEARPPWGTGGDGAPGPPRRTRFSWGSRESWAPRKRWCVCCSRLPGR

SEQ ID NO: 3229 - protein, 28 aa, Homo sapiens
RVWLVSQVLKAAEGTLGPQDHLLSSCQE

SEQ ID NO: 3230 - protein, 81 aa, Homo sapiens
DPEDPKVQWASLAQMDPQVPSACQGQMGPLGKGASLEKSWELSPGHGEMLVCLDSLGLKAFPETEAPLDSEEAKGCLGCQG

SEQ ID NO: 3231 - protein, 166 aa, Homo sapiens
KVIGAHQGHQVLLLFLEAKVTQGTQELQEPQGPKDGPGTPGPRAGLVCLVSQEKKGPGVNKASWGTLDPPGRWATEAPRDPRETQDSLVPPGLWEPPGLQESPRRLPSNQGQWVPRGGEAPLGHRGRWGPRAPPENQVFVGLQGKLGPKEEVVCLLFPASGEMKDP

SEQ ID NO: 3232 - protein, 57 aa, Homo sapiens
CCPGRSSTAPPSPSRSSITASLAAGLWWASVPSAPWRASCVTPTRRRVHPHRVAQTM

SEQ ID NO: 3233 - protein, 50 aa, Homo sapiens
SVRQLQCPPAGHQEAAHRGLAGPAGVLHTAAWSCAPVPAPYSSGALPDSA

SEQ ID NO: 3234 - protein, 107 aa, Homo sapiens
TLYGMRDLNGTSRASPWTRALSFMWWSKTMRRWGGTGSWGKPRSHSERSSPPLVCPPASMPPCWTPRSSPQGPRWSCRCPTHRCLELCPCSRPLLLWSPPRLCLTWM

SEQ ID NO: 3235 - protein, 15 aa, Homo sapiens
HHHPPGAEAEALGPC

SEQ ID NO: 3236 - protein, 80 aa, Homo sapiens
TGRRCFPRMTLSAHWAGSGKMRNGPQTSTGLSMSKAGSIASPSPRSGSRSTGSLLRRCTTHTDGGAGCACAGGISAKWKH

SEQ ID NO: 3237 - protein, 58 aa, Homo sapiens
EAFFGKLFRRSKFEAKPTSGPWQPGRNITTKLIQRPLRSSLGSRKTPPSLPFLGEEEL

SEQ ID NO: 3238 - protein, 78 aa, Homo sapiens
PWTAQREPTPDPEAGTRRKAGKGMAPCPLGLEKWGTAKSPPTLHPAPLGRLLPPSLWIVSPAARAACPGTNPPKGKML

SEQ ID NO: 3239 - protein, 71 aa, Homo sapiens
TSVLHLGHHRLLTDPGLLRGNRLQTQRRGPGGRRGRGWLHVLWGWRNGGQPSLLQPYIQPPWGGSCPRLCG

SEQ ID NO: 3240 - protein, 45 aa, Homo sapiens
RRPGSPGPHESPRSRFAHPPSHPTSTCSRCTGRCPMLTEREATAA

SEQ ID NO: 3241 - protein, 84 aa, Homo sapiens
DSPNSSLSCFGTWLGWTWNSSALCWVPLTWARDPRGPGQDWPKQRPRRGPPWPGTSSGQGVTAMVGGPPMPMPGQREAPGRQEA

SEQ ID NO: 3242 - protein, 62 aa, Homo sapiens
LGPETPGDQARIGQSRGQGEAPPGPERLQARGSQLWWGGHQCQCQGKGRHRADRRPDTAQEG

SEQ ID NO: 3243 - protein, 37 aa, Homo sapiens
KNENRRGQKKGHCCIQGCVWFKFQPIHGNQTISYHSL

SEQ ID NO: 3244 - protein, 30 aa, Homo sapiens
NQLQTRQSYILTGKNGFLLKQIWFLLVAKS

SEQ ID NO: 3245 - protein, 209 aa, Homo sapiens
KKNQKKQVMKLRKEERPRPTRTKVRVHRSLRKAPVKMTRQKGKRKWTQELMTKMEMLLSILKNTLRSSSSLWRKKTRKPMKKVERMALLTKVSSPRRKKNGRTLIQRSRCQRLWRGRSMPPVGRLVWRTCRTHRPWSWLGPHLRRSRGKRNTEVELQMQTRQKAMNRISLPSWPPRSTPGKTHRVLRGNLGRLTMNVPWVITMSVCTRG

SEQ ID NO: 3246 - protein, 71 aa, Homo sapiens
EPKRTKKRSLLYSRMCLVQIPTHTWEPDYFVSLPMMFSWATQSFPVGAVFLTRPAIPCCSCTSHSNPWSQS

SEQ ID NO: 3247 - protein, 135 aa, Homo sapiens
TWTTVQDTDVSMGGHAWMASTPITASALLSGQASSARRTWMSVSCSPTPATMGVPASTRWVATAACVSMAGQARAAVRISMTVPQPCASMGPPAMTAWLLSTVPAPWARLASCVTWMTPVSATPATRMLSVTQIR

SEQ ID NO: 3248 - protein, 239 aa, Homo sapiens
TLTTVPATPAPLESAVMASTATTVSANLASQGPFVTWRSMSVLPAHAAREVPVWMGKMASAASARLAPCPHSASPRAIPVPMSPAVTASAMMHLAGSAVCVSLAGVAPAAARAWPETPVSPSRAGPVGHAAAMEWVSTAPARLVSRDVSVNSSPPAPRTPVSMGAAASLPLASCLSAPAPRAGKAHDASRMWTSVLAPHPVALMVSAPTWQGVSAAPAMEGTLALPAIRTSMTVTPTHA

SEQ ID NO: 3249 - protein, 201 aa, Homo sapiens
RGRGLQPPLAWTEARVQMEVVAPSCPPGRLPACARLAGWVSGVSWRTPVTQAPVLAVVSARVQWWLAPPDSHAGAPVASEALTAPCQIPASAALVPTVPAAQWGPMDASSAPAHLATRAAAAEATWMSAGWVSPAAMVAPASTHLAPSAASVQLATQGHYVRTPRCPVHPHHAVTGAPAGRVATSLTTVPVFLGLRVRIVK

SEQ ID NO: 3250 - protein, 327 aa, Homo sapiens
TRSAACAVPATQEPTANMRQTPASRGPAYTGASAAPPTLASAAPASRASRARSARRWWIGAAASLVKTGVAASRLGPIAFVPLDGADASVTSEACPAGRPQPRSGCGWSSCVRRVGSVWMKTAPTTACAQRAVLVATVSRRWTPAWPSPASMGGPAVAIWGATCVSVFLATMVITVRTTWTSVPPSPASTGVHALTSWPAISAPVPQERWGCSARLMRMTAAQAHRWTQGPGAYTMAPAWTWWVVSAAPVPQDTLVCAARQTSMSVAQVPATRHTPGTACRTQAEVSVAFVMLASQVLAVRLSCLPASPSHASMEASAVLARVLGVG

SEQ ID NO: 3251 - protein, 108 aa, Homo sapiens
ASATRPSTGWWCWSRTMASLRARPPPRCTCSWWTASPSPTCLSRRRPRPRPRPTCSPSTWWWRWPRCLRSSSFRCSCSWRCGCVGGAGRPRWVAAWCPRAPFQGILWT

SEQ ID NO: 3252 - protein, 30 aa, Homo sapiens
KNNSISKNFSPMKSILRQEMLEPFLENAPF

SEQ ID NO: 3253 - protein, 13 aa, Homo sapiens
TKKTTRFRKTSVL

SEQ ID NO: 3254 - protein, 36 aa, Homo sapiens
KSTGQREPSRVQHHDHRHRLGDTQAENRVQHNRAAL

SEQ ID NO: 3255 - protein, 108 aa, Homo sapiens
ASATRPSTGWWCWSRTMASLLARPPPRCTCSWWTASPSPTCRSLRRPRPRPRPTPSPSTWWWHWPRCRRSSSSRCSCSWRCGCAGGAGRPRWVAARCPRVPFQGIWWT

SEQ ID NO: 3256 - protein, 92 aa, Homo sapiens
HSQQWMVDPRPSLGQLWFSSRCWTSMIMPLSFLRVSMRCKSPRTDPLAPGLPPSQLRIWMQETMEKYLTHFSMHQKIFVKHLKLIQYLGKLI

SEQ ID NO: 3257 - protein, 45 aa, Homo sapiens
GKREGLFNSQPSKGSGTKGRGTGREGGPSCVQREQTAFSAQSSDR

SEQ ID NO: 3258 - protein, 29 aa, Homo sapiens
RNWPRGGPKLCPKGTNSIFSSVIRQVICS

SEQ ID NO: 3259 - protein, 181 aa, Homo sapiens
AGLPGDQGGGGGRRLGPERLAVVPAAQGHGARAVRRVGAQWRSAHRQAAERARRGQAQAGGAGQGQWRASALGHRHAACAPGGRLLPALPASPGGGTGPGPGRLAHRLPGGGIGLGVFALPLFGAPVRGGAAVQEEQGGLGGSLLGARGPLSRADGGRERHRDPVPELPVRGVSDWRLRDK

SEQ ID NO: 3260 - protein, 440 aa, Homo sapiens
PQGQPASLPVLRQMPAASAQVTPLPGLPHRAPRGPQVPQAPTSLHQVVPCLPATRQRHLPTSPALLGATHPRVPLIPPLHPPTPLPLHPILQPVPTIVPHHPAIRQRHPATHRPLPATHPPLPATRPPLPATRPPLPATHPLPLATRPLPLATRQRLPATRRHLPATRQLHPAILPLLPATHLPLQAIHPPPPATHPLPQVTHPPARTILQPVPITPQHHPATARHHPAIHLLVPTTHLPALTTAQPLQATLQHHPAIPRPHQVTPLPAHDTHHSLQPIPQAHPATAPARPATAQPHPSTPQPVLLTVPAPQSIPQPLPSTHLPVPNIHPPLPSTRLPVPPIHPPPQNTPQHLLLIPQPLQSTPQPLPSTHLLAPLTRPLPPSTRPPAPPTRPPPPKAQPTLPLPLVTRPPAPPTVSQARLSARMTVTRRTEGTWGAAAG

SEQ ID NO: 3261 - protein, 35 aa, Homo sapiens
LSPPRAIGLSWVLCRTHSQQCANSPRETSSWSGVK

SEQ ID NO: 3262 - protein, 33 aa, Homo sapiens
WAKEWTSRPVLSSPPTPTSPLTRLACPAPLLPT

SEQ ID NO: 3263 - protein, 70 aa, Homo sapiens
KFCAVSASSAPNCLWTLTTQRSRISWLSPRDSPRSGSHMSTTFARAKTYARVGRRWTTSSVWNNLRVTRI

SEQ ID NO: 3264 - protein, 31 aa, Homo sapiens
AGVPAGRPPRCPQWPGQRRLSAGSGVLTAGC

SEQ ID NO: 3265 - protein, 81 aa, Homo sapiens
WPDPGLEPPMLQRVAQRMAQSVEARMGRRAWKHTEMHLGQVPHRPPGRRKRPLWRVTQKQAPCGRQCLMSQRTQRPQPQEW

SEQ ID NO: 3266 - protein, 80 aa, Homo sapiens
WPDPGLEPPMLQRVAQRMAQSVEARMGRRAWKHTEMHLGQVPHRPPGRRKRPLWRVTQKAPCGRQCLMSQRTQRPQPQEW

SEQ ID NO: 3267 - protein, 74 aa, Homo sapiens
AASQSSARQFFQQDHWQSHCKKNRTGDYVFEEEGQVHQPGVEAHRHLSAYGPAAAPGQLCGASRAPAGRPALAE

SEQ ID NO: 3268 - protein, 47 aa, Homo sapiens
ISPSQLAVSITMETYLHTLPATTGQRDMNFIIPRKKITFSCVMQPKS

SEQ ID NO: 3269 - protein, 109 aa, Homo sapiens
HHLLMIALVVCLLAHQPCRGTFLLQDHGLMMFAAGKFKTVDRPFQKPSRCTLGLCLMSAGVTMGAKCLRHRVIKLPKCGTSAVTKRYRSHSMMLLLKPSIGSKLQTTAV

SEQ ID NO: 3270 - protein, 64 aa, Homo sapiens
NISIGVWLFLKTNRTSLLVLPWEVSRGELLFTISTPRTPPKITSPLNVIDLMEPTLQLLRTFMR

SEQ ID NO: 3271 - protein, 154 aa, Homo sapiens
TAPPGMPRPRATVSASCPLWLAPPRSPRSRQPRRSPSSSEGIHGLLGSAWPFTSAPLRPSAPSWTSSPSACLSPLGCALSPHPGACIASAPWSSWKMEAATSALIRSPPRPPVDQAGHRRETPLLSSCGMSKASVKPQAPPPPGRVLKPPGGYC

SEQ ID NO: 3272 - protein, 126 aa, Homo sapiens
TPSAVCGRATLGASQSLGCGDPGPAGWDAGKSLAEAGSQGPSMKSGRIPCMPPREREWQLGRGGDWPSTSAAVACGATGLPGGRDAARTVPAQPPAPASPRARSQSPPAAPGPRRTGWTVPAPLPR

SEQ ID NO: 3273 - protein, 36 aa, Homo sapiens
SSCTRPAGKRWTRCRPCCTAPLCWCVPGMRPSEPQP

SEQ ID NO: 3274 - protein, 28 aa, Homo sapiens
RPRRLKGRPSQSQKEKLKVRKRGALRSV

SEQ ID NO: 3275 - protein, 22 aa, Homo sapiens
RPQRQKGMPRRLKGRPSQSQKM

SEQ ID NO: 3276 - protein, 22 aa, Homo sapiens
RPWRLKWRPRRQKGRPSQSQKM

SEQ ID NO: 3277 - protein, 15 aa, Homo sapiens
RPQRLKGRPSQSQKV

SEQ ID NO: 3278 - protein, 15 aa, Homo sapiens
RPRRLKGRPSQSQKV

SEQ ID NO: 3279 - protein, 57 aa, Homo sapiens
RPQINPAGRRVMRRDRNFMLGCHIPPRGRTWQQTWGSRHSSWTKISRESHPAQGKAG

SEQ ID NO: 3280 - protein, 55 aa, Homo sapiens
ARCGAQSCLPSGLRECRRGCPPGFWRWQSAELTPCREENAASYHGPGGRGGNPIG

SEQ ID NO: 3281 - protein, 40 aa, Homo sapiens
DPGVNDPCQSSASSTPTTPRSHPRTRGQHTATPGRTRMWF

SEQ ID NO: 3282 - protein, 27 aa, Homo sapiens
KSRQNGLLSLIHLPRTPPQLLHQKHHQ

SEQ ID NO: 3283 - protein, 75 aa, Homo sapiens
HLRRKRNLPRRKVLAQPYWRRRPLSPLWGPKLPALWTQRVQKGLSPRLLEVAECRTHPLSGGKRCLLPRPRRQGR

SEQ ID NO: 3284 - protein, 36 aa, Homo sapiens
KTSLSAVAIGVNFLSLRTRNCMQPLMLMLVLLFTEI

SEQ ID NO: 3285 - protein, 18 aa, Homo sapiens
KKERHVFGRVFLKMTSPS

SEQ ID NO: 3286 - protein, 13 aa, Homo sapiens
KKIGNNCTAAEMS

SEQ ID NO: 3287 - protein, 62 aa, Homo sapiens
VQRRSLTWRSYILINHVIRFLLGVTFLKKVSWYSHQKKLTVPHSLLFRHKSRRLRLCYMANW

SEQ ID NO: 3288 - protein, 36 aa, Homo sapiens
WLGLRIRQEPRPKLKKRLLYKLKLEQRGRLLVLLGL

SEQ ID NO: 3289 - protein, 100 aa, Homo sapiens
NSGPRKMLTVIGSNKNPGLRRKSLLGPGSGQKKRPVWRVELQQSVNLSQELRRGPLADPRTGLRKSPVWGLWPEKRPSRSLKKRPYLGPGSGTEMRPALT

SEQ ID NO: 3290 - protein, 21 aa, Homo sapiens
KSCCGKKTIQCQSSFNICGSL

SEQ ID NO: 3291 - protein, 20 aa, Homo sapiens
DKFFGKYDSHGSTLSKSKHD

SEQ ID NO: 3292 - protein, 78 aa, Homo sapiens
LGQRLSLVPRPSLKRRLGKRLSLGLRERMMSLWWSDPRLGPRQLLGQGPKLRPSLCLRQGPKLRPKQCLGQGPKLRSK

SEQ ID NO: 3293 - protein, 107 aa, Homo sapiens
HPLDIMLPWSPPHLECSRLLLGPLPLTHSSILGALVEFCLDPQWVPRGEGLPHQWGALMGVSSTPHPLLPFQYQALGLVVLPQQSRLPLQWVVGTYLLLHHQPTSPM

SEQ ID NO: 3294 - protein, 80 aa, Homo sapiens
GFLIHPLVVALQQPPLPVLPPLPLPPPSQLPRHCPATPTLSLPQQASLSPISPPSILSLLSHPRLCGARVPHHLLPMAAS

SEQ ID NO: 3295 - protein, 63 aa, Homo sapiens
DPSTMHQPLPLAWGPNHYLVICPLPTPWDRVWVDFLLAQRRAQLWLLHPTLCLLLPLLLQRPP

SEQ ID NO: 3296 - protein, 63 aa, Homo sapiens
TPSFCDTHWISCSHGAPHISNVPGSSWGPSPSPTALSWGHWWSFVWTPNGSQGGRGCLISGGP

SEQ ID NO: 3297 - protein, 73 aa, Homo sapiens
HSQMHRIMLTTDYFRKHSNCVVFLPTPFCTTLRNFFLSSLILAVLCTNCIFRYTASFLQAFMLPGFLKHTKRK

SEQ ID NO: 3298 - protein, 70 aa, Homo sapiens
TVCTPCHHSGSSDKVMPWRMLSTHQPINTVEASLFLHGTTPSAGVYPEIFPKRSRKSASVATYFLPGVTS

SEQ ID NO: 3299 - protein, 56 aa, Homo sapiens
QAINSPKRTRQSSSYFFTNGADVRYTCRIFEISSIPLSKIRWINKRRTEETSSRSF

SEQ ID NO: 3300 - protein, 54 aa, Homo sapiens
KSIQILNKLSNGEKTCGFLYLSLLNLMQENYINYISMLLKNGRSLSKTVIKTAT

SEQ ID NO: 3301 - protein, 246 aa, Homo sapiens
MDTVMKKVLETVVENQASRMMILGQLQALDLVRVLEAVVMEAVASQVAVTLTPDLNQAVSQSLSQTLPEKTKFKQNHRKLMELSFGNLVLVFWPFRDLQSSRSSNSSSSNNNIKPHLIADQKRIPLAVKIPMTHQVRSKGKSIKMKIGKCLGQDLHLSLVQIQNLKKRERKAVVMKQNLIMSQKTKSKAENLKIDLSQKMERRFLDKKRDRLIHLRRMMMKKIMIMIKEVLVAKQLLMLAIRRMKK

SEQ ID NO: 3302 - protein, 21 aa, Homo sapiens
RSCKKRSSFWCGKFKEEKSKS

SEQ ID NO: 3303 - protein, 47 aa, Homo sapiens
SKKKRKRKQPWKNQWTWKRKKSKMMVKCLKKKRKVNLRKRVKKKLKS

SEQ ID NO: 3304 - protein, 37 aa, Homo sapiens
KNRHMYTTNKRSTRARRKGRESSPGKTNGPGRGKKAK

SEQ ID NO: 3305 - protein, 22 aa, Homo sapiens
RKNIKIQSIKKPTYVYHKQKEY

SEQ ID NO: 3306 - protein, 16 aa, Homo sapiens
TLKSSLQTGRLIFIPL

SEQ ID NO: 3307 - protein, 60 aa, Homo sapiens
RKPFRPHLNQPASMQLPLKSSRYSSRKMKVLIYKLLNFRNLILTFLVNNWKNITNSTRTQ

SEQ ID NO: 3308 - protein, 18 aa, Homo sapiens
QKKVLPHHLLSFLSIKML

SEQ ID NO: 3309 - protein, 77 aa, Homo sapiens
HTFIMKTLNLSKLIDGNRNICITENSLRFPYFHCSGNGRLLVYGGRMSAPRKSLDVKNLYKKICSLLILICDQLFLK

SEQ ID NO: 3310 - protein, 62 aa, Homo sapiens
KKCRFIGPMLRCSLPLLLNCHILVLEKEVSLGLDLQLTLSTLFTTEKKLLKPTFVIPCKSLK

SEQ ID NO: 3311 - protein, 48 aa, Homo sapiens
GTGSLGAETEAEEPQRTQWEGEEEKKNPPGGRCPPRPLQALQVHGEQP

SEQ ID NO: 3312 - protein, 45 aa, Homo sapiens
RRKKKSTRREMPSQATPSPPGPWRAALGKEVKRSQSKLRLRNTSP

SEQ ID NO: 3313 - protein, 33 aa, Homo sapiens
GGNQSWQEAQKTQEGKKGGPGPHSLLGPGPLVL

SEQ ID NO: 3314 - protein, 82 aa, Homo sapiens
KPPQTLDRVRRKPELARSSKNTRRKKRGPRTPQPSRSRTLGSVRPGRPGMLGTLAQWGRRMRNRQPWGRNGSGRAPENTMGR

SEQ ID NO: 3315 - protein, 212 aa, Homo sapiens
TSAWRAISASLTASASTLTAPLPVLVPLATDPDPAEPLASTLTSAARRTFARAASVPTPTAPSSASVLRDTALARTSPPASTWTNVASEAQPCAGRSAVRTLPAPTAVSGTAILGTTRAPRAPVTMWMSAKNMVPRFVEPSVVRTPLAPTAAHQPVTLAISPRQGADARMWTNAGTGPSAVPTPCARTCPAPSSASVTRVTRGHGMGVTAWM

SEQ ID NO: 3316 - protein, 373 aa, Homo sapiens
ARPGAGAASSAHPSAQRVSGRSARLVLVTTTRPPTSATTPDPWARSHPECHSASLVPCQPPLGHLQAFCPPIAWSPGLNPGPIPGPALSFPCPASLPGLVLRFLNQVPPPACVSATPRSAAQDAAFPGPAATPALATLASGSAPRAPDALMWTNVAACPRPVLPGAARTHQAASAACAARASEPAHGLRNAWMWTSATACRRRVTSGAARTRQAASCACAPPGTRLHRTEPAARMWMNAPRAQACVAEGPARTCLALSAVFARLASGARRVKRMWMSVPRSRRPVGPAAVTTRQAPFTVPALLASAPEGPGPPAKMWMSVPEAPHPAPTAGVRTQKAASSVSAPWASNPTLLAPSARMWMSVRTTSHALGRSV

SEQ ID NO: 3317 - protein, 156 aa, Homo sapiens
TRPRATHAIAATATTTTHSGWSASTMTSAPMRNRPVRAAAVSTLWALITVPASPHWCWMARSAAASPTRARASMTIWECAGRKWGLTSCAATLGWTVRPPTQSAAACMERPGAWTAPSALRRTQMTSRPCAMCYAPPHIAPRDQVALDSPTSTAQT

SEQ ID NO: 3318 - protein, 60 aa, Homo sapiens
HVSSRTAQTDGCTAATKGQTHAAETATATAAAAAAAAAAAAAAATALKSDFKLVSLRTSL

SEQ ID NO: 3319 - protein, 22 aa, Homo sapiens
QIFLQALIQFRELGVKTYFRPS

SEQ ID NO: 3320 - protein, 13 aa, Homo sapiens
KKMWRRSIGSGSQ

SEQ ID NO: 3321 - protein, 71 aa, Homo sapiens
TLLSTSSAALCWRTSWWIWLFMPWSDLRPRRSLTMGEQANSCGSISQVSSFSLCFSSLQVFHIWCFLFIRS

SEQ ID NO: 3322 - protein, 70 aa, Homo sapiens
ISSTSSAALCWRTSWWIWLFMPWSDLRPRRSLTMGEQANSCGSISQVSSFSLCFSSLQVFHIWCFLFIRS

SEQ ID NO: 3323 - protein, 41 aa, Homo sapiens
KKITHTRWGITTWDSWSVRMKANWIQAQQNKSLILSPSFTK

SEQ ID NO: 3324 - protein, 40 aa, Homo sapiens
TSRCSWRNFEESSSQVKRAGRINKYEKKETQVFCKVMDDA

SEQ ID NO: 3325 - protein, 23 aa, Homo sapiens
GQKKGQHFYWHCGSAACHRRGCV

SEQ ID NO: 3326 - protein, 19 aa, Homo sapiens
TRKKLLTPGGELPHGILGQ

SEQ ID NO: 3327 - protein, 90 aa, Homo sapiens
RQLGMPQWTTSPSTWPCALPSSGGNSRKQGSQEGLEGAPLTPEDLMGVAGRVGVPEEVTVLRSLLCPAWRASVKSSTPSTSHLEAGRSRR

SEQ ID NO: 3328 - protein, 16 aa, Homo sapiens
VGGKESPGREKGMEKM

SEQ ID NO: 3329 - protein, 70 aa, Homo sapiens
GQGEAALVGWVGVPVRKTLVTGEGLWEGERWAPQALLGPPAPQSQVEKLSSCSGPTPCSWRRENTARRGM

SEQ ID NO: 3330 - protein, 55 aa, Homo sapiens
VLPVILKMTQVMSGLLSPSRHPLWIQPTIRGKKDSPLKRWWKRSCQRKPWLLESP

SEQ ID NO: 3331 - protein, 30 aa, Homo sapiens
QRCLFYKGSATLFPVEVTMHPMECLTHQCL

SEQ ID NO: 3332 - protein, 100 aa, Homo sapiens
RFRPQSGLRNPQRIWRTIYVHLRSRSPSSSLGTRRCPVLEKIAKPRRRKKEATPKRSSSQPVTLQPVTSKDFSHRLTRGPRNIQLSIMTRASHRTSPVTP

SEQ ID NO: 3333 - protein, 92 aa, Homo sapiens
RQKLPQRPALGQQPLKANWASRLMSARGEPSTLARSGAGSQEQSCHPHPKNPKQPSSTPGLFLASRMFQPCLPTFSHLWRLHQQLCTHFQHS

SEQ ID NO: 3334 - protein, 188 aa, Homo sapiens
RFRPQSGLRNPQRIWRTIYVHLRSRSPSSSLGTRRCPVLEKIAKPRRRKKEATPKRSSSQPVTLQPVTSKDFSHRLKTPVRRKSGREEEAKASHSKSNSCPRNVPCASHAPGTHSPQNPVLSLFLFTVNLQSGHKKYNFAWILQSPHLWSFPVLSIQQWRLAQDCKLVSDSIWAYDLLCLLARHSLWV

SEQ ID NO: 3335 - protein, 40 aa, Homo sapiens
KLPRGSSNKNVLCCQSEKCNEHAKPAKKRRGRTARAARRN

SEQ ID NO: 3336 - protein, 112 aa, Homo sapiens
MPCRAVKNYFQWNHYHHDHHLISLAAPVSLSHPTSSGIHSRGASASHSPFGAEMKNRMILFQQMWKRLRWWRVWLEKRIIMMNRKNTGKKMLRQRDNMMSMMKTGVIWSWTC

SEQ ID NO: 3337 - protein, 29 aa, Homo sapiens
KNRNISSECRFQRCSCCSEDWKLGTILYL

SEQ ID NO: 3338 - protein, 141 aa, Homo sapiens [sequence omitted]

SEQ ID NO: 3339 - protein, 24 aa, Homo sapiens
PYIIETMQQKILIRLLEMVIFSLI

SEQ ID NO: 3340 - protein, 167 aa, Homo sapiens
VCIRKSIQEKNLMYVLNVGRPLSGSHILSHMKEFILEKNPMNAVTVGNPLLKNHNSMCISEFTQERIPLYVQNVGRSSLTRQISLYTRKFIQEKDPIYVLCVVRPLLTGQISLSTKKFILERNLINAATVENHSPGSLGSGYIRSVILERDIMNAVNVGKHSFRSQH

SEQ ID NO: 3341 - protein, 57 aa, Homo sapiens
RAYSSAPPTHHPQCSAPSGRALGCTSTPSVPRPLRPALTSSSAPCSIKWMGPLASVW

SEQ ID NO: 3342 - protein, 55 aa, Homo sapiens
CQEGAPTWSSLCTACTRLRATFRSPWRLFCSEGPTSHGHTCSLTIATQVQTSGPL

SEQ ID NO: 3343 - protein, 52 aa, Homo sapiens
RKPPRRKRPAGTPPTPTSRPASRPPAACGPWCPQRPGPPAPSCPTGTSCAAS

SEQ ID NO: 3344 - protein, 270 aa, Homo sapiens
VASSTRRPLLLAQPRRGLQTAKGGTLPVPAPPHRGPRPAPQPAPTRPQQRWTPSFPRSLASHRKSRPLTCSQPLIPGPPRTAPPTRQSRSQIPRCSRPGPPRSAGPKAAPCLPACLSSEARRSLPVPSHRATASSGSGTCRAVPKAKATTCLLSTSPRPCPRGRAPSLARDPAAEAPRRSPRPAPAVAWRMLCPSLPRSSGSPRRPRATPGRPAGKMTPAPPRRSRSTATPSCARTPGSPASRRPRRQAGSLRMPRRSSASSSSSRRNLL

SEQ ID NO: 3345 - protein, 128 aa, Homo sapiens
RIGEVYLTNVRCVGKPLIIPVYFVYMKEVTLERNLMNASNVGKPSVVPVTLEYMKGLTLEINPMNASSVGKLSVVPSTFESMNELTQERNPTNVNSAVKPLGAPVLFEVTRGLTPERNFLNVRNAGRL

SEQ ID NO: 3346 - protein, 206 aa, Homo sapiens
STLAMDLINVRCVGKPLISPVHFESMKGPTLERNPMIVSNVGKPSVVPVRFENMKEFTLERNPINVQNVGKPSVVPVTSESMKELTLERNPMNVSNVGKPSVDPLTFEYMKKFILERNPMRTLTLTLQLSQFFHEHERSHIEKPHESKKFGKAFSPFCFFQLRERIHSGERPCKIIGFKLRETCDRTVKPRVGVGSLDCVMSVLVG

SEQ ID NO: 3347 - protein, 41 aa, Homo sapiens
MFSGSEHTWASCPRSPSCLTAALLRTLPMETTAGWCHRKRL

SEQ ID NO: 3348 - protein, 34 aa, Homo sapiens
HPGWRERGPVEWWAEAEDRHCTCPGSQPQDPPAG

SEQ ID NO: 3349 - protein, 24 aa, Homo sapiens
KMQLMNPKVKLMPWKCLQMIQDPV

SEQ ID NO: 3350 - protein, 50 aa, Homo sapiens
KLTARTLDRKRRKKERNLRPLHRMKHQLLQPKRSQSQPQWDKHILIFPKT

SEQ ID NO: 3351 - protein, 34 aa, Homo sapiens
FWKRNPLKKMKTLPLIQGKMLCPQGPTVRQNRHQ

SEQ ID NO: 3352 - protein, 29 aa, Homo sapiens
LQKKNPPRLLNLCQRTERPGATRSLVRRN

SEQ ID NO: 3353 - protein, 23 aa, Homo sapiens
WNRLSPLTRWKPLQTVRLMEAPP

SEQ ID NO: 3354 - protein, 51 aa, Homo sapiens
NPAHHPWLQPDNTSECVSAAPRATWATWLSTGAQCWCRWAPGTIWLGCPPC

SEQ ID NO: 3355 - protein, 113 aa, Homo sapiens
HMHHLQAPGVQPVWLQPNTPPGGENRVALSELPNQAATGGQPRRADPPAAAHLTAAPCRGPSPCIWNIPSEAERATGAGPAFRPPACQGQPSIHQGQPSAQQGQPPGQAPQGF

SEQ ID NO: 3356 - protein, 22 aa, Homo sapiens
RKLSLLLAKNFPHSGDHAQHGS

SEQ ID NO: 3357 - protein, 80 aa, Homo sapiens
TAGHRDQGGPPQCHRTEAAPPHHPTPSLRSPPFPAARCVPYARLRTSRRPPASQTSTPAPSVTTRSATSVGSTPTLISPR

SEQ ID NO: 3358 - protein, 77 aa, Homo sapiens
RLLSWPRMASIGPPLHMQPSLPWQGLKDLGSLVSLCCTGVSPALPQTCHCKRRSSGRPAVVASRSGTPCHACGMPVS

SEQ ID NO: 3359 - protein, 68 aa, Homo sapiens
SKMVAPLPLVPVPPSSLPLCPSLPPPPQTAAGAELFPMSVSLSILQRRLRTPSSCTALLPPPAQPPRR

SEQ ID NO: 3360 - protein, 28 aa, Homo sapiens
TPPFPFSNIHLHLQINNHTLTSYLPRTH

SEQ ID NO: 3361 - protein, 23 aa, Homo sapiens
MIQLPKLNPPVPLLEHTPTSPDK

SEQ ID NO: 3362 - protein, 136 aa, Homo sapiens
IETHHPGPPAATVWRSPRTSACCARESTRQDSVTGQPAGSPDSSQECPRAACQGSNYPAAGAAATAKNPDCTTTTIIAATAPAATLHPASDSVLCTAGSDNGTRTKPRTKTFSTSQGGTAATGWLFPRGLFWALCS

SEQ ID NO: 3363 - protein, 47 aa, Homo sapiens
DELQPSPLNLKEKVPPLLRQALLLLKTGQIFLWMTPTFGKSGPKRLT

SEQ ID NO: 3364 - protein, 43 aa, Homo sapiens
NCFGAYGNKFYATPFWKIGWHCVSLLVLNCPNGGSLFGMMGSF

SEQ ID NO: 3365 - protein, 32 aa, Homo sapiens
RCTASSLVIPTRERCLIRPASSWGWIRLCFNP

SEQ ID NO: 3366 - protein, 20 aa, Homo sapiens
EDSKRMLKKTWHPNRKQLLK

SEQ ID NO: 3367 - protein, 92 aa, Homo sapiens
LASLLLLISRRRAILKWHCILSRMRKLALVWHWSVETLRLLWKQPKHWMTRTAGKSWEKWPCCRGTTRLWKCAISVPKTLTNFPSCILSLAT

SEQ ID NO: 3368 - protein, 13 aa, Homo sapiens
GKKTCPLVRWNRM

SEQ ID NO: 3369 - protein, 62 aa, Homo sapiens
NLCLCVNRAQPLCDVCSVPPHRRLGSISQPGPDCARLGYFWSEEKKPVPWCGGIGCERNNWG

SEQ ID NO: 3370 - protein, 282 aa, Homo sapiens
LGLQGTEHPSLRKRGFLNPVGPCALPGQLSPSQMWQSSLGHWARKCPRATHASRLLLGATPWNSVLDFWVELNPSSATAGAVTSPPSLSWGCCMRGRNVPSLASKCLTRHPTATQQTWPLQAPGTPAPTSLTGGQQRGQGCMPWASLTSAWCCPVRARALLILTAGCPATSTLACGAQQCTCAIRWAWRRPTRWCTRQSCWAATRRRTMRRSRCPSQCPSSACPWGPLSSAGLPRPSTPCPSSPPLCSRVQLVIRCMVPPCSSTRRSQGPGYQSDRHGHWAC

SEQ ID NO: 3371 - protein, 92 aa, Homo sapiens
VGGDPRLVGDRMRQAPPDEGWVPASNSCSLLPATPLPPAFPHLSCLLTCHPQPAAAPWTVFCTPGSALDPLPPRAQPLWAVSGTSQNLLSAT

SEQ ID NO: 3372 - protein, 53 aa, Homo sapiens
RNGQRDFRKTPFQKNCEAHHGKDASPHALYPSSRGVPGPKRGVFPQKYQRGNL

SEQ ID NO: 3373 - protein, 47 aa, Homo sapiens
RILYVRFFCQHCPSISTGRVQPWESHLEKSLIPLSMNQTCRPCLGRQ

SEQ ID NO: 3374 - protein, 36 aa, Homo sapiens
CAPFSEEYYMSGFFASIVLQSAQDEYNRGSHIWRSL

SEQ ID NO: 3375 - protein, 21 aa, Homo sapiens
NIDHTGKNGLIKYQTRWSNTI

SEQ ID NO: 3376 - protein, 20 aa, Homo sapiens
AKTTGKNTTLFSSLMCMPET

SEQ ID NO: 3377 - protein, 59 aa, Homo sapiens
LKYLEPDTCLLLKQTVTCLDMIYIAVPWQIFSVSLPCSHPFVWGYMHSGEVGNLSYSRN

SEQ ID NO: 3378 - protein, 54 aa, Homo sapiens
RGEMLSIIHHQGFPPTMLPPWILSLKKMKNQISQAVSFSQARNLPKGQASSRQI

SEQ ID NO: 3379 - protein, 73 aa, Homo sapiens
IPNYGKLLQMFVLPESRSVLEDWRTPRSLYMRVLLGRHQGTASPHPCALPRPSMGPSQVEWCHHSLTAAITAA

SEQ ID NO: 3380 - protein, 69 aa, Homo sapiens
LQPSRMLVKESLAFWQPGFFEYSRLKILRVKRNGKKHVVSHLLSSSFLSLAALYLELLFWLYLELTQSI

SEQ ID NO: 3381 - protein, 59 aa, Homo sapiens
PQPLPLATARAGGGPLGASSASSPPSLYADLTWWAVAATTKKRKNFGRPSPAPSASRGV

SEQ ID NO: 3382 - protein, 42 aa, Homo sapiens
MNLKAKTEWRRSDLTWWAVAATTKKRKNFGRPSPAPSASRGV

SEQ ID NO: 3383 - protein, 40 aa, Homo sapiens
PQPLPLATARAGGGPLGASSASSPPSLYAEICLSGLPEGT

SEQ ID NO: 3384 - protein, 122 aa, Homo sapiens
PIAAPHPHPTRYSAACRPIPSSGASATRQLVLPFPPLILTLRRLRVTTQKISGLRRTGSQGGKPAAQPRCLPAPCPVWRGRRPPQPPPRTASSPPAQIEAGIPHFWSGPASARPPSRMAKTA

SEQ ID NO: 3385 - protein, 121 aa, Homo sapiens
PIAAPHPHPTRYSAACRPIPSSGASATRLVLPFPPLILTLRRLRVTTQKISGLRRTGSQGGKPAAQPRCLPAPCPVWRGRRPPQPPPRTASSPPAQIEAGIPHFWSGPASARPPSRMAKTA

SEQ ID NO: 3386 - protein, 108 aa, Homo sapiens
PCQGPGPPRLLLLPQSLRPGPASTRNPCRPPCTPTRPLGCPPRRVTVRCRGPAQPPSVSLLPPHPPTTSAAVVEPQTELTSPGVCPAEAPSMLGSSDRCGTSRICPTV

SEQ ID NO: 3387 - protein, 31 aa, Homo sapiens
PQPLPLATARAGGGPLGASSASSPPSLYAGT

SEQ ID NO: 3388 - protein, 177 aa, Homo sapiens
PIAAPHPHPTRYSAACRPIPSSGASATRQLVLPFPPLILTLRRLRVTTQKISGLRRTGSQGGKPAAQPRCLPAPCPVWRGRRPPQPPPRTASSPPAQIEAGIPHFWSGPASARPPSRMAKTAQPPSVSLLPPHPPTTSAAVVEPQTELTSPGVCPAEAPSMLGSSDRCGTSRICPTV

SEQ ID NO: 3389 - protein, 176 aa, Homo sapiens
PIAAPHPHPTRYSAACRPIPSSGASATRLVLPFPPLILTLRRLRVTTQKISGLRRTGSQGGKPAAQPRCLPAPCPVWRGRRPPQPPPRTASSPPAQIEAGIPHFWSGPASARPPSRMAKTAQPPSVSLLPPHPPTTSAAVVEPQTELTSPGVCPAEAPSMLGSSDRCGTSRICPTV

SEQ ID NO: 3390 - protein, 68 aa, Homo sapiens
PQPLPLATARAGGGPLGASSASSPPSLYAEICLSGLPEDLTWWAVAATTKKRKNFGRPSPAPSASRGV

SEQ ID NO: 3391 - protein, 46 aa, Homo sapiens
NCRRKQKKWTLLGEVISSLSWTVLSKMSMISISYWKKQKSRLSGRL

SEQ ID NO: 3392 - protein, 42 aa, Homo sapiens
NCRRKQKKGEVISSLSWTVLSKMSMISISYWKKQKSRLSGRL

SEQ ID NO: 3393 - protein, 35 aa, Homo sapiens
ASAAPPPLSARAPPWVPGCPQRRTGLSLGPMTSLW

SEQ ID NO: 3394 - protein, 110 aa, Homo sapiens
GCPACPPMTQDSYPRMPSSPSHHPPCRQRPPTSCLTGFLTIVYQVSPTWGPRVQAFSLIACLPPACSLGSPLSTFQTTLIITPLGPACSRHLRSLAGRTGLSLGPMTSLW

SEQ ID NO: 3395 - protein, 104 aa, Homo sapiens
SLSRPQPSQTSQGCCQPLQMGQKSGGSTALSRHLWVRAPKVSPACPPQCGAAKLPLTLHFQARSPVSLRSTDRQFQKVKLKTRNGNPQVPLSPQARFQRVTLQT

SEQ ID NO: 3396 - protein, 40 aa, Homo sapiens
TCTYLLYLLPMVAPHFLKIFKNIVIQMNGKFTLKNILYLI

SEQ ID NO: 3397 - protein, 35 aa, Homo sapiens
PFLIWLYLGKDILLSTPALKKRPPSRIRMHYICFL

SEQ ID NO: 3398 - protein, 18 aa, Homo sapiens
KAKKKRRKWQIRHVLKNL

SEQ ID NO: 3399 - protein, 139 aa, Homo sapiens
VMTLTLGPWRVCRIWKKSGKRRRRGRMRSRDRGRAHRRRLRRTTLTLRWRQCSGWSARPFRRRSCGASASMIPLMGPWTSTSCQGQLLPTWASPGMERLPASRFLPTWPSSPSPATSPHSPSSWASWTPTGMPSLTMKP

SEQ ID NO: 3400 - protein, 50 aa, Homo sapiens
RARGRLEGRVPSPVAPWPSAVSTSFRWRGSWGLGRGPQGSHLATCKRTAQ

SEQ ID NO: 3401 - protein, 83 aa, Homo sapiens
WGSTPSPKPALLHYIPHLWPLIPSVYLPNLLPGLSVCCDSGHPGQAGCPGGWAVVEFAKGCASPYSESPCHGQEAQFAGITAE

SEQ ID NO: 3402 - protein, 183 aa, Homo sapiens
SDGPSWFRTKARGPWNWPSSRACWGRTACSPPRPPCLASSRFCRLSLTCPRSSASTCRATASTVRMSGVLALVSMFYRPPAPLSPFPSPAPLTRQPMPTWQPWPAAWSALASPHSQWFSSLTATGSSASCGSSCPSGGLGASSPLMGLHSLTQACSPTLYPSPLASHPFRLSTEPPTGALCLL

SEQ ID NO: 3403 - protein, 68 aa, Homo sapiens
PIPQNPSSLMRRARAPSQGVTAPMLWPGPSSIFPAALETPRWSWTFPMPPGPLRTLRCGRAAGFPKLG

SEQ ID NO: 3404 - protein, 50 aa, Homo sapiens
STGINSARKKSRIYPRCLRMPWSCLRCMPGNRGAEKTTLTLLKASEPYWS

SEQ ID NO: 3405 - protein, 35 aa, Homo sapiens
RLALMPISSCSITHLKATPPKKTSGTKSSRKSMNS

SEQ ID NO: 3406 - protein, 34 aa, Homo sapiens
KTISRSRSPLMGSPSRCSQKIRESLSRCWPPSTL

SEQ ID NO: 3407 - protein, 120 aa, Homo sapiens
TLRPLWGPSPMARTAPPLPMPPPPRRPLPPPPRAAQRTVTRGKRLNNRAPLGEATGSRRQGEQNTEDSRKAKPDFWKVQNSFGSLVPEREKMLVPGGTRVCQLILLILCVHAKIGPCYMK

SEQ ID NO: 3408 - protein, 36 aa, Homo sapiens
GHCGGHLQWPGLHPPCQCRHLHAGPFPLLPELHSEL

SEQ ID NO: 3409 - protein, 107 aa, Homo sapiens
PPSTVRRLCSALMCRTHQSTSRRLVRSLGLGQRLSKLWQKTQSLCRFRQHLLSPSKYHSLSPLLDSLHVQTFFHRFDPSLWPRITFLLPQHHLPCSQLLSLSRGPSC

SEQ ID NO: 3410 - protein, 106 aa, Homo sapiens
PPSTVRRLCSALMCRTHQSTSRRLVRSLGLGQRLSKLWQKTQSLWFRQHLLSPSKYHSLSPLLDSLHVQTFFHRFDPSLWPRITFLLPQHHLPCSQLLSLSRGPSC

SEQ ID NO: 3411 - protein, 151 aa, Homo sapiens
NLKENEYLKILCMCLSMNVSIIIQRTRNILRNLKNIIGNVPALDRGQIQMMMIAIQRKKDSDQSLVLLQNILLVQSLREVIKSQKSIRRKVRRGDINLTLQNPMLSERRIKKKKIGKVKKTELDKDQNQNTNRLRKRLERILVIGILLAAN

SEQ ID NO: 3412 - protein, 56 aa, Homo sapiens
LLQPDTKKQSKCLERWKFGMQYQNVIVLKSMKMFCSFFQKKKRNKQSSCEREIGKP

SEQ ID NO: 3413 - protein, 42 aa, Homo sapiens
VKKSKPLMPIKSRQKKKKKKKQDQSTKRLRNPFSVFLKIMRK

SEQ ID NO: 3414 - protein, 14 aa, Homo sapiens
CPLWEGHQWDKCLE

SEQ ID NO: 3415 - protein, 57 aa, Homo sapiens
VPHPPTSDSFTGSDSGGDSALRKCEDPAVSSVSEQTSSLVLQPPSAMLCFDKNDFPI

SEQ ID NO: 3416 - protein, 40 aa, Homo sapiens
LKTTLRKSGFFSKTQRRYKLSSLKEDLLQRSAFTSQAPLY

SEQ ID NO: 3417 - protein, 51 aa, Homo sapiens
EDCGPIQSTYSWSERSTPKVSVTQVPCQILCAHKISAHQHKEWTTGKCRKS

SEQ ID NO: 3418 - protein, 46 aa, Homo sapiens
GFQPISEQQLADRGKPCKDHPLYCKRTAAQYNLLIHGQSDQPPRSQ

SEQ ID NO: 3419 - protein, 40 aa, Homo sapiens
WSERSTPKVSVTQVPCQILCAHKISAHQHKEWTTGKCRKS

SEQ ID NO: 3420 - protein, 29 aa, Homo sapiens
VKVRGLGPLKNTREGGWTNNQHCLIEGKE

SEQ ID NO: 3421 - protein, 21 aa, Homo sapiens
GGKRMMQTCQEEGMTSKTITH

SEQ ID NO: 3422 - protein, 280 aa, Homo sapiens
AHQVALLTMALQVPLSWHPLGVGAAEASLALKQHHTRNGHLNFRRVSAAFVPTVSTQHLSIIFPHPPWNMGHPSRESQWGHHLPHLSLLRIMVVSSLEMHPLIYPLWIFRTPSQRRQPWPMLPHPLLLESTVEFLSLPHLLLPLLGNIAAVVGVVSPFLLHPLLHPLLTTLELYPSQPHHWQSTEWQGLWQYFPRTIVPSFKGPWLSILGYSQDPGTTGAPPNGTSTALALAVYERASPYPPILWNTWAHPMEEEVGEAATAAVAPPWVPHTETPSAGVV

SEQ ID NO: 3423 - protein, 65 aa, Homo sapiens
ILCPCFLRSLALVPQHPAVQDHHPLGEMKATPESSPILYLHIDPLVWAVNLPISSLLMEWRDHLP

SEQ ID NO: 3424 - protein, 249 aa, Homo sapiens
PNGGSATASARPPRRPRPPRPPLLVRPRARSPGGNASAAARPRRPPRPRRAPSQRRPPRPRPGTPRSTARGTASPAPTPRRPPAAAPAPAPAPAPPAAARAAPTAAAGAAAGRGPGRSGDGGGAPPPRPRPLPHRRPRGASGTAGNTGTVAAARRRRSGRGPGVRSGLGMAARRPRRPPRRPLAPPRVVTATAAAGGPCHPPSRTSRTTTSSPSSGPSRWAGLTSPTPEDPLLLRPPHLSGRSCTTPRD

SEQ ID NO: 3425 - protein, 80 aa, Homo sapiens
ATWCGPTSSATATSASTVASQGTPQGPHGRPRSQGPQTRVARACPCPLSESPGQLFAPHLFETLDVFMAPPPHLPPPSVG

SEQ ID NO: 3426 - protein, 163 aa, Homo sapiens
RSPRRIAAARRQAPRGRRRLPGPGRSGQPRFLAPRPPRQPHHPLPSLRTRRPWTAAARHLRSPSCPRRPLRRLGSEVGRRRRRRKKKRRRKRKRRRSSSLLPPRPPALLQPPQALPPARGPQPVTRGRRTGQLPVSPSCPRCPRPCPGICQLVWTAPPAASWP

SEQ ID NO: 3427 - protein, 254 aa, Homo sapiens
LSCWNRKERRWWTPPRRAAGRAGRAASGSYRETSQLPGPPGARRRRSWGPGKVGRPLFPQKRPPRLPRGKQRETKQVVMSRRRKGRGLLAPKGPRTSQKRSFRRGWGRLKVEIKATQRARRRRRNPTREKKTKKKKKRRRKQKRPQPKILSHRPRRKRRKRRRQQSRLYDEHQHQAQGFPSRAVAIPMPLTSTDLCPPWVGTKLLPSLAPQKKTASFRGPCAGQASEPAGRLVQGESGPAPMTSPHSPNTGRFI

SEQ ID NO: 3428 - protein, 40 aa, Homo sapiens
RWRSKQPKEQEGEEEIRQEKKRQRKKRKEEESKKGLNQRF

SEQ ID NO: 3429 - protein, 88 aa, Homo sapiens
NLPLPWAWGPWGKAPAQCHPGRWGLQPPQPRWGSGRRTQRAVVRSHQTAVMERCPQLWPRLRKSPWGTSSRPNPPPVLPRGPLRRQGL

SEQ ID NO: 3430 - protein, 165 aa, Homo sapiens
PPRPRQGSQRRTQRAAARSHLTVRRRRQLPRPCFRRRPQEKPLRSELPQPLPRSPPGKELPQRPLGRQGLQLPRPRRGSGRRTRRAAARNRTVRRRRLLRRSLQGRPPRSEPPRPLPRSPPGKGLPQHLLGKQGLQPPRSRWGSRRRTQEAAARSQTVTERHWQP

SEQ ID NO: 3431 - protein, 61 aa, Homo sapiens
SLQGRPTRSELPWLLPRSPPGKGLPQHLLGRQGLRLPRQGSRMTQGAAARNQTVMGRHRQL

SEQ ID NO: 3432 - protein, 30 aa, Homo sapiens
KNIFLLLEKVGLNFVDIHHKIVFCRVLRKP

SEQ ID NO: 3433 - protein, 25 aa, Homo sapiens
SNTAWEDFFWCTAVVAPTYFLHFTH

SEQ ID NO: 3434 - protein, 32 aa, Homo sapiens
TRTVSELTLERCPMNAVTVGKPSFFSLPLRNT

SEQ ID NO: 3435 - protein, 107 aa, Homo sapiens
ELPQDRSFRSMSNVICPSAYTLPAQYVSKYLLERKVMNAVTMAKYLPLVSTQKLVVWRRVWNVMNMRKLSLTLCPFRTVSELTLERCPMNAVTVGKPSFFSLPLRNT

SEQ ID NO: 3436 - protein, 79 aa, Homo sapiens
EPTLERNPMNAVTVEKPSSISHPLRNTHALTLERSLMSVTSVESPSAQALTLLCTRELTLVRKPMSVKNVGRPLGIPLA

SEQ ID NO: 3437 - protein, 298 aa, Homo sapiens
LSIREFILVRNLMSVRNVEKPLFVVQILLNIRMFMLVGNLINVRNVGKPIFGAHTLLDISEFILAGNLMNVSNAGRLLLGLRILLNMRKFTMRGNPMNVRNVERPFFMAQSLIDIRKFILVRETMNVRNVERPFFVVQNLIDTRKFILERGHMNVKNVEKPFSGVHNLLDIRECILVRNLTYVKNVGNLLSGVHSLHDIRKFILMQNLMDARKVATSLVTIHILLNKKFIIVQISVNGQTMGTPLVMSQTLLNTRIFTLLRNPMNLKILRKHFLQALTSFHSCEILYKSVGRALFMTH

SEQ ID NO: 3438 - protein, 162 aa, Homo sapiens
FTQVRNSVEIKNVGIPFFLIQKLFNIRQFTLLRKHMNVKNVGSLLVYVRVLLVIREFIPVRNLLNVRIVGKPLDFIHNLVSISEFILVRNLMNVRNVGRPLVVAQILLDIREFILVKNPMNVMNVERPLVSDHILLNIREFTLVKNLMNVRSVGKLLLVDHT

SEQ ID NO: 3439 - protein, 134 aa, Homo sapiens
PAQPSRGGREGCRAHGQEALARTPHLSPSPQLTSSSASAAPPGGPMFLCRPSTSRTAWPWPPSSCPRVYSHPFRLPWLPRCPQTAPCNCSSSEMAASSTATATPPALELLGLARGVAWPPPSSSQEPVAVAWET

SEQ ID NO: 3440 - protein, 41 aa, Homo sapiens
CWWTSTCCGWPSARTRPAAASWVPWSALGGPPSAPMPSTSQ

SEQ ID NO: 3441 - protein, 118 aa, Homo sapiens
RCLTSACGPQASGSAPCPWPKATPARRWRSWCWRPLPPTAPPSVLPTTAGTSGGPELWLASQPTSPACSIPSPQCPWAGVPRAPEPPAGVTVPAAGSQGTTPTVSTPTTSPGCCTPSC

SEQ ID NO: 3442 - protein, 31 aa, Homo sapiens
AFCCYSYVFWHILRVHLRRSFLFGHCPSVLN

SEQ ID NO: 3443 - protein, 85 aa, Homo sapiens
SMSGFISSQFPGSGVMYSNGSTLSILLLCPLGHCMVHGHICYFSTMATNNPKKSKRKLFLAFWLTVETRLFAVIHMFFGIFSGCI

SEQ ID NO: 3444 - protein, 16 aa, Homo sapiens
SKKKQTEIVSGILAYC

SEQ ID NO: 3445 - protein, 81 aa, Homo sapiens
TPSVCFCGTDFSLHPNKKHPWICPFSLQFIFCLVWKNFIRAIYLPVSHMAGSGHKGYLGTDTWKPYAQHHCQHFHICLCGT

SEQ ID NO: 3446 - protein, 19 aa, Homo sapiens
KKYTNPNLPSVQCDGTQPE

SEQ ID NO: 3447 - protein, 17 aa, Homo sapiens
VSWMKKIHQSEPTKCAM

SEQ ID NO: 3448 - protein, 156 aa, Homo sapiens
AKRGFTWLFRMWGPASPWYQSVCSIKSVHSQSAIWPSFLTPSQGLIRLPWWKFEAPVSTTQKRKMCQKCTVGQMVNGWYPLATAYATLGMRSGAENAKLAKLDITRLSPRMPPVPSAHPTATLSGKEPPRAPVTEAFSELTTMLPLCPAPVHHLLP

SEQ ID NO: 3449 - protein, 51 aa, Homo sapiens
TAPGPRIPSADVNQTFFVTLLYVNTVTLAPNVNMESSRNAHSPATPSAKRK

SEQ ID NO: 3450 - protein, 68 aa, Homo sapiens
TAPGPRIPSADVNQTFFVTLLYVNTVTLAPNVNMESSRNAHSPATPSAKRKDPDLTWGGFVFFFCQFH

SEQ ID NO: 3451 - protein, 121 aa, Homo sapiens
PPALIQKKITITVQVAWQHSVVHPGLACLPCLLWMRYMNLSQRIVTWEVMAVKDFTVKKIQTLIMKMILLETVAMHHSLVQKSLKKGSQAKRCENRHVKKLMRSSKRQLDLCSTLLEFVHV

SEQ ID NO: 3452 - protein, 35 aa, Homo sapiens
NVRSLFLLKQHCKKRGVTAMHFIIPVLYDYKRVIL

SEQ ID NO: 3453 - protein, 34 aa, Homo sapiens
INVFRKWKEAMARLMEKVPYGVLIRNINPILSRH

SEQ ID NO: 3454 - protein, 77 aa, Homo sapiens
REMMCHPLDQLATRTQKKNQRLQSPHTPLVFSFIWPLSTLQINVCLSKKFIAGFWTIFHILLLHQQAGRILFDIICP

SEQ ID NO: 3455 - protein, 30 aa, Homo sapiens
SHLNDFGLSIKIKLSKKIPSLNAQWMFLRI

SEQ ID NO: 3456 - protein, 28 aa, Homo sapiens
ESRWKSNWKKWQSYSRNSGQIWCGSSEN

SEQ ID NO: 3457 - protein, 23 aa, Homo sapiens
KRLEVSWNLWRILFRFLGISLEK

SEQ ID NO: 3458 - protein, 127 aa, Homo sapiens
SRHWVSRGPTSWLEKAPWTRGSPAAAVEGSWLSCPMGWGRLGAPRTRRTTMGKTSRHPSSKSWRTSALRRRPTRKPWWRPFCRRTRGVWRRWSSPTCSSTTSHSGRWSIPLASTSPTCPNTSTRALP

SEQ ID NO: 3459 - protein, 108 aa, Homo sapiens
WRSAIGRNASREGCPHHRHRGWAPTSSRRCVSTTGLPTGAKKKPSGTSWPWTRTAGPPQGQARDLRCPLTAPLACLHLPSPPVRSTVCAMDSLRPVRLQKYPQAAAVP

SEQ ID NO: 3460 - protein, 28 aa, Homo sapiens
VCHLRARGPPHPSLATRDQTGACLARPG

SEQ ID NO: 3461 - protein, 15 aa, Homo sapiens
IPPWVRRATTSDTQW

SEQ ID NO: 3462 - protein, 76 aa, Homo sapiens
CPRIRMSKRNWIFCLTRRWSRWMGGRTPSLPGLMRNLTMRLMTGMSTRSSLSPRHHITCAGTQGGTAQATTPRVPR

SEQ ID NO: 3463 - protein, 65 aa, Homo sapiens
SLKCPERNWLHAPLAHRSLDTYLPIAERSKGLSLPPTCPWPPPPQPGNQRSNRSLPGTTRMRHRV

SEQ ID NO: 3464 - protein, 39 aa, Homo sapiens
DLLPHPQHSMVTPRGLAWSPRSPRGLSPQSAVAALGRPS

SEQ ID NO: 3465 - protein, 83 aa, Homo sapiens
SLELCVSWATAFSPAITTACTPPSTLDLVPGLRPLLGLPTCQPLPGGPPGLQGTDQRHGCPGPVGAGSGALSGPGHSPELQLP

SEQ ID NO: 3466 - protein, 305 aa, Homo sapiens
SSGRCCAAPPCSPRWALAATCSRREAQDASAGSPRQHPPRQRPRPARPSRPLPRSSASRSRRPTPRPLLHPCCWTWVSLWASGQPRAPDVRRSPAEALSHPHRGHHALLLAPQAPHVHHPWASSADLGPRPFAAALIPGALCQLGHGLLPCHHHSLHPAEHPGPCSRTQTPSGTPHLPTPSRGAPRTAGHRPKTWVPRPRGCRKRGLEWARPLPRAPAALGGVTAYTGTGAGSASAAASVSPGTPPPFGGQEHYTAQEAFTLEGGPAPPHLKPVGPPSSPALLGPNTVPSWLGGPEPVSGNCLLG

SEQ ID NO: 3467 - protein, 53 aa, Homo sapiens
LASESFSRHHALITPRLMRKLPKKYSANLRNQTQRTPQQTQSNGPREASRKQT

SEQ ID NO: 3468 - protein, 25 aa, Homo sapiens
SLFPLHNVLTIAKKMNLPFGSFMSQ

SEQ ID NO: 3469 - protein, 60 aa, Homo sapiens
TLNASTACCSMSATPQCVLPEGAVKTSAFPSANIQRLKFSAHYSGVGVYGQKQILKRVNL

SEQ ID NO: 3470 - protein, 143 aa, Homo sapiens
PSDQQGNGNVRGISVTSAGRKQPPSVRCAPAPFVSSIEKGCFSFPNWMGVCLVLSMTPVGPILWNLGRSVSMCLPQYRCLQGQALTWQSNQQEWLLRHPKCQINLLLTPTRCCRSPKKLWQGLVRGHCYLKDLLRELTPGPSL

SEQ ID NO: 3471 - protein, 115 aa, Homo sapiens
LLARRSGQLHLIRSHHRLMRRCQCWSQVHGLPAKVWGICRELLRKAVCQILFRHLGKQQPLQRTPGKLLNHSPRPDFFLSLLPRPFYMSQQLRPQEELLQGLSRPQGLLANPRAW

SEQ ID NO: 3472 - protein, 32 aa, Homo sapiens
DMMWESSQSSFLDLMTICGLTRPESSLTWRVT

SEQ ID NO: 3473 - protein, 27 aa, Homo sapiens
AARIRWAKEWMGHIKKLFRKLQQGLRN

SEQ ID NO: 3474 - protein, 127 aa, Homo sapiens
AVTPWVWQPHRPTSTPHLLNGCTTNTTPRGRTFASRQLSPWSLPSSPSCCVASRRLQTLWRPSRGPGQHAQRPARLGCTPTPAAPPSSSGNSIWACGAASCWPSASCWCALSSSVLCCSSTPGRLAS

SEQ ID NO: 3475 - protein, 24 aa, Homo sapiens
VHQLHREAGLGGGHPPPCPRALPE

SEQ ID NO: 3476 - protein, 92 aa, Homo sapiens
PWPSTHPPCLVPTSIQPLMSPLGPLLPLALATSVPGDQVQPLGERAAEAQRPCVGRVGSLGSTGSGVRRRMDPWRALLLLHPLSRPSCHGPP

SEQ ID NO: 3477 - protein, 38 aa, Homo sapiens
SQLPAGPGTLRKGPSHEGVSTGTQRGGPQGRPQQTSLH

SEQ ID NO: 3478 - protein, 100 aa, Homo sapiens
PSAAPLPPPSPEPSATVRSGWKPGGTPRPSSPQTWGMRMWAWGHPPPGRGPPCSPRRGILLTRTALSSCHPPCRVPRPGSPKTISWVAPRPVLRVRLGGR

SEQ ID NO: 3479 - protein, 100 aa, Homo sapiens
TPANQPTLQTARSQPVFQTVCLPHSCHPLKALTPSPTLGSRRWTAGVAATTTSRRPALSPPCLASPPCLPKVERMWTPAQSMQMGKHLWLTNPQYLLSQK

SEQ ID NO: 3480 - protein, 182 aa, Homo sapiens
QATLSWQNTSRTTRKQTLCPSERPRRTPTAGGGPPTRWPPPGSCCAPTVTTTSMPALPTGPSAPRPPRTAACHPSCCSRCPASPRGPRRPLGATCPGPAAGPHRSTGWAAQARTARGRSLSGMSGRLLLLVPTRTHSRPSSTRGPSGSSTVPCPGGSSSLSSHTNPKWTARSPFTAVTGSKF

SEQ ID NO: 3481 - protein, 71 aa, Homo sapiens
SSPEACPCRTPLRTSPLHRSLCPRPHHHLPQPLTTAPSPQLQESTGRLSLRSIRILPPRCPPPPGPTPWPP

SEQ ID NO: 3482 - protein, 30 aa, Homo sapiens
HTHQPDGAPESLCRDCRPANHQLAEILHQR

SEQ ID NO: 3483 - protein, 103 aa, Homo sapiens
LYPLPLEATLQWETRMMMTMMMQMRKCSHQGSRMVVTSVRKARNRVRWTMEILRWCLSRWSWRQLKMSTMATPLPWRPCWQAQRASPPCWTSHLMQMTRPWLN

SEQ ID NO: 3484 - protein, 49 aa, Homo sapiens
PESIIFLWISYSETHQTQIFFEEKWCSSIPAKQSWRKHDVGNLSGCRIR

SEQ ID NO: 3485 - protein, 28 aa, Homo sapiens
EKKFDLVAKKHNGYVLQKKLHFTFYTCL

SEQ ID NO: 3486 - protein, 122 aa, Homo sapiens
HTLVMGLIRVQCMRSLLIFLVYFKCLRALTLERKHINVNIVIKPSIIQVIFVNMKELILERNPMHVRNVVNHSLFPVLFANMKDLILERNPMNVRNVAKPSVVPLTWEYMKERILEKNPMNV

SEQ ID NO: 3487 - protein, 131 aa, Homo sapiens
SAMKNCLLILLMLLLFAIHINRMNVRNVGNTLVVVQILFSIRVFILERNPLNVRSVGKPFDFTYNLLDIRNFILVRNLLNVTNVERPLVFLPCLIAIRTFTQVRNCLNVRNVGSPLIVAQTLFNIRVFILV

SEQ ID NO: 3488 - protein, 70 aa, Homo sapiens
NHMNVRSVGKALIVVHTLFSIRKFIPMRNPLYVRNVGWPFDIITNLLNIAKFILVRNPLNVKNVERRLLF

SEQ ID NO: 3489 - protein, 68 aa, Homo sapiens
QSLFDIRRFILVRNPLNAGNVGRPLVFSTSLIAIRTFTQVKNRLNVRNVGSPLIVAQTLFNIRVFMLV

SEQ ID NO: 3490 - protein, 322 aa, Homo sapiens
NHMNVRSVGKALIVVHTLFSIRKFIPMRNLLYVGNVRWPLDIIANLLNILEFILVTSHLNVKTVGRPSIVAQALFNIRVFTLVRSPMNVRSVGRLLDFTYNFPNIRKLTQVKNHLNVRNVGNSFVVVQILINIEVFILERNPLNVRNVGKPFDFICTLFDIRNCILVRNPLNVRSVGKPFDFICNLFDIRNCILVRNPLNVRNVERFLVFPPSLIAIRTFTQVRRHLECKECGKSFNRVSNHVQHQSIRAGVKPCECKGCGKGFICGSNVIQHQKIHSSEKLFVCKEWRTTFRYHYHLFNITKFTLVKNPLNVKNVERPSVF

SEQ ID NO: 3491 - protein, 34 aa, Homo sapiens
KSWVTAFQKTVIQMAISHGTGMEKCYIPLKERWS

SEQ ID NO: 3492 - protein, 74 aa, Homo sapiens
MLREWQPSPRGIFVLLTRTARRNKKLKYLHTDGCEAQCNRRLQVFPDRQKKHDCFNSHHSSLFGFVLKPKWRSD

SEQ ID NO: 3493 - protein, 42 aa, Homo sapiens
VAAHLPPSLQPPAPPAPPRFLHGMLAKFRQPPLLTPCGRQTL

SEQ ID NO: 3494 - protein, 94 aa, Homo sapiens
HPVEDKLCKCGRWKPAAIFVRSASCPSTAAPSSRDIYQSPDPHAAPTRCQDAQRNGSLEPAEQACPAWDLTDQAPTSAPTAAQPPPAEEACAGG

SEQ ID NO: 3495 - protein, 90 aa, Homo sapiens
DLRSPPEWQPTSRPACSPQHHQRPPASSTECWQRSPDPHAAPTRCQDAQRNGSLEPAEQACPAWDLTDQAPTSAPTAAQPPPAEEACAGG

SEQ ID NO: 3496 - protein, 137 aa, Homo sapiens
RQRDGHQPQRGDQDADVHLEQHLLQPGLRRPRPLQGLRGGRGGLRGAHQRPEWRPHVQRGGRGGAVHAGHGGGGLPRLPGHGPVHHPRHPGAGPGAERHLRLHRLRQDRGVTPAVPGAAGAHESAPQDPAAPGAQRP

SEQ ID NO: 3497 - protein, 47 aa, Homo sapiens
WPSTPARRPRCRCSSGTTSSSAWASTSETTTRTSGGTWRPTWRPPTT

SEQ ID NO: 3498 - protein, 122 aa, Homo sapiens
WSCSTRSARPSRRTSLCCRRKGSSATRSRGSPPHSRCTAGQPPRRSMPWIACVQRTPTPRGWAMRSTFLDRPETGMRSCRRRGSCLARTCLSGCSEKGPYSRCTATSPRQPPGAPWPSLTAT

SEQ ID NO: 3499 - protein, 19 aa, Homo sapiens
ISKKSTTNLSVHQGLHMVV

SEQ ID NO: 3500 - protein, 67 aa, Homo sapiens
VNGRRITSQLHLAYVPDRRQMHTVHRYYAFSMHGQTLRFPRSVLPNCSKNMQRNILQLLILTMLNLG

SEQ ID NO: 3501 - protein, 111 aa, Homo sapiens
RLWRWHSHGFSISRQNYHSNSSAARGRQTAYDEGEMVEGQWLPRRGEQRGQCPGGSEYWWHLHCSGSRLGAFSFCGSGRIFIQIQKKRSIGKGIFYLVSATIPSRHCLVIF

SEQ ID NO: 3502 - protein, 102 aa, Homo sapiens
RRNGGGAMVAQKRRAKRPVPWGFRILVASSLFWQPAWCFQFLWQWENFYTNPKKTLNWKREPRLSYLKTMYSSLFWSQFPFLQCCHHHHLHHHYHHVLNKYI

SEQ ID NO: 3503 - protein, 67 aa, Homo sapiens
RRNGGGAMVAQKRRAKRPVPWGFRILVASSLFWQPAWCFQFLWQWENFYTNPKKTLNWKRGPSVVPW

SEQ ID NO: 3504 - protein, 65 aa, Homo sapiens
RRNGGGAMVAQKRRAKRPVPWGFRILVASSLFWQPAWCFQFLWQWENFYTNPKKTLNWKRNLLFG

SEQ ID NO: 3505 - protein, 30 aa, Homo sapiens
WRTVKEAAKKKSATTTTVILEIIIMDRVIP

SEQ ID NO: 3506 - protein, 20 aa, Homo sapiens
IMAYTEKWKYIGPIKPLPKK

SEQ ID NO: 3507 - protein, 89 aa, Homo sapiens
LVMKNSQILRMKEKEVEEMWLIIRKEQRKLELKKIRKKQRTKKQTLRKKINPRTTVVKKQIPKEPNQNSSATPEFDSLTNFRKSLKRKY

SEQ ID NO: 3508 - protein, 53 aa, Homo sapiens
IKPGAGAARRPPPWGEAAGGSLHLVLRPLQQVGGCPGRTAPEKDGAEAPPCVQ

SEQ ID NO: 3509 - protein, 80 aa, Homo sapiens
TPARTWRSGRLWRSLSRSFRAHQVQGRRSWASTSYSGFINQTRSRCSPEAPPVGRSGWGVPASCTAAPPTSRWMSWQDCS

SEQ ID NO: 3510 - protein, 169 aa, Homo sapiens
WLCGRPSSWVASSGGTCSHPLPLMATGARPPLASPLGPSCTARPAWSPATLRRPSRTTAHPRSTHRWWPSTRPCPGSTVPHPRDSPSSSSAQSLTSVSMGTPAPRHTQHRSCRSGSGARRLWSCGGRRPGRTGWCPTRSGCWPSTSAAAVRSLCWQRPLMECVSPATSP

SEQ ID NO: 3511 - protein, 35 aa, Homo sapiens
MAGAGASPSIPSCQLLALKNSSLTAASSPVHPWTW

SEQ ID NO: 3512 - protein, 23 aa, Homo sapiens
PHRSCFPPSIPWKRSVACCYVAS

SEQ ID NO: 3513 - protein, 85 aa, Homo sapiens
WLMEGWSQPYTQPLLQRSRILKPKKKHRRKKKLMNRKRMPQHFIEAGLHWIKTLLIRGSVSLLANSVCLWFSSYNSFLETLLLRL

SEQ ID NO: 3514 - protein, 15 aa, Homo sapiens
WSHFLQVRTVEIMRK

SEQ ID NO: 3515 - protein, 45 aa, Homo sapiens
VFSLSLCWSSWPVCYGKKGLSLSYGPVSPIIRRLWNIFVRNQEKI

SEQ ID NO: 3516 - protein, 114 aa, Homo sapiens
TGSCRTGTAAAAPGTRETASAPATSVTHTSKCASRSISPASRPGGPAASAQGPRLSSGATPSTSRPAAATTATASCCLSVSPGRGPIRCLWRRGIPVMTPFNLTVLLKRLLTRA

SEQ ID NO: 3517 - protein, 31 aa, Homo sapiens
TEKRSPPTARRQNTQTGQTNRTTETWKVPRA

SEQ ID NO: 3518 - protein, 225 aa, Homo sapiens
PVMTTTMALAAISSAAPEMTSLDTMPVTRMATKLAWKAGWAPNVTELFADKAAVLSMGLANSQVTAGASTAGKACTVISASHTRDASTASVMSPGSASVRPTGAASSVTKISITVGLISRVSTGELVATQALTNISVPALRGIQDPTVKLLSTPASLIPVTTEAAVRRPPWALSVSVPQAGPAPHALQTLMTVLLITVPTGAPARTWLTDLSVCAPHSGLGKRAS

SEQ ID NO: 3519 - protein, 167 aa, Homo sapiens
LTAAQWPWLPTTHLKGCGIFPPTSVVLTGSARVSREANSPVTVTKASREHTAMKILMTVRATLVETVALASMVSTPTSASVVTAGRGPTVKPILMTAARTPATMGARVATWSMTSTVTVKMGGKERPATHVTVSVMRPRATTVAPAMMRGMLLSACVLAAGKEQPVT

SEQ ID NO: 3520 - protein, 135 aa, Homo sapiens
ATARSWTAGWAGLTRAPGTKRALSTTCWGTNPRAPPTPREACASLACKGTPCRAGTSISAWTLCWPRGRGWEGATSRASRMRSMSATVSSWRSSATWRTATSWASSFPGPPEATAPWTSTATRAWATRWPCWRRS

SEQ ID NO: 3521 - protein, 46 aa, Homo sapiens
PPPQSAMSIMTRRSLWRAARRRQTAWMSWSMRRWSCIKAATGTSWA

SEQ ID NO: 3522 - protein, 99 aa, Homo sapiens
DAAPASGGTAPVTTCSWWTVALRPTSPSSISWRWASCVRPPRPWSSWSRTSSLSSPQSAMSIMTRRSLWRAARRRQTAWMSWSMRRWSCIKAATGTSWA

SEQ ID NO: 3523 - protein, 93 aa, Homo sapiens
DAAPASGGTAPVTTCSWWTVALRPTSPSSISWRWASCVRPPRPWSSWSPPQSAMSIMTRRSLWRAARRRQTAWMSWSMRRWSCIKAATGTSWA

SEQ ID NO: 3524 - protein, 17 aa, Homo sapiens
CCRRWSCIKAATGTSWA

SEQ ID NO: 3525 - protein, 68 aa, Homo sapiens
WRWASCVRPPRPWSSWSRTSSLSSPQSAMSIMTRRSLWRAARRRQTAWMSWSMRRWSCIKAATGTSWA

SEQ ID NO: 3526 - protein, 62 aa, Homo sapiens
WRWASCVRPPRPWSSWSPPQSAMSIMTRRSLWRAARRRQTAWMSWSMRRWSCIKAATGTSWA

SEQ ID NO: 3527 - protein, 125 aa, Homo sapiens
SLIGTVCVSGTWPTTRSPLWSMETVPLSCSSTTWETTSPMAGLLREAVASATRTGGHSRGGSLPPGCFWPCLWNSLLRFCPASCSGCYSWTIPPTGSPFSCTTTRSSMNPTSLTPGRSSRTTSQL

SEQ ID NO: 3528 - protein, 63 aa, Homo sapiens
GRLWLLQPGPEDTPGGAASPPGVSGRVCGTAYSVSAPLPAAAATPGLSPRQGHPFPAQQRGLP

SEQ ID NO: 3529 - protein, 60 aa, Homo sapiens
GTHEGPRCGLPWPQPWPLSHQWPSPGARLEHSGRFSGVQALEGWRAGRGGQCFQEPLPRC

SEQ ID NO: 3530 - protein, 34 aa, Homo sapiens
AACLSWPCPMDSMKMALRAQGGMRMMMRRTRTSC

SEQ ID NO: 3531 - protein, 70 aa, Homo sapiens
ASRMRATAASASRPPSHPSSSSGPVTALSQGLGWALGTWRLRGTWGQLVVMGSWAAPCGAPSPAAALRMS

SEQ ID NO: 3532 - protein, 22 aa, Homo sapiens
RIHKMQTQFLEEIPWLPDVWMR

SEQ ID NO: 3533 - protein, 21 aa, Homo sapiens
KTFLLWKNWKRALSTRKICSK

SEQ ID NO: 3534 - protein, 44 aa, Homo sapiens
RKSPNWREHPKKMSKEKEKLVHLKRNQNLKRAGRLPKGTVWQRQ

SEQ ID NO: 3535 - protein, 33 aa, Homo sapiens
KEQADFQKGQFGKDNKKGNRCVLEKPGFQGAGG

SEQ ID NO: 3536 - protein, 25 aa, Homo sapiens
RTQDQKGSKGHRSGRNVFICPSQFK

SEQ ID NO: 3537 - protein, 61 aa, Homo sapiens
KMPKSHQKNCQYLLNLVKFHGRILLHTFQKQMKKMTLCVRRRPLNQKRMEDLQIVILEHQT

SEQ ID NO: 3538 - protein, 45 aa, Homo sapiens
PAHNVTLIFVTDVVRDTASSDFLETTHQTSVYLDANIATSQRDLI

SEQ ID NO: 3539 - protein, 16 aa, Homo sapiens
KTEKTITDRYALVTCR

SEQ ID NO: 3540 - protein, 186 aa, Homo sapiens
AAAAGPRSRRPWPVALRATLSPRGLRGTAPGRPRCAPPPRSRAAVAAEATGAARTPAPQSPRGAWGPRAGVRAEHRRSLRDWHSPGLSIPRPCHCSWSWRRKRRKLGIEKREGMNSRRRPPAKSWSPGPAWGPPTDWSWTCWVSGARPSPRDKSSAPCTAWRATCPRPPPRSSSRRPRRHLGLRQC

SEQ ID NO: 3541 - protein, 39 aa, Homo sapiens
PAPAPPVSNLSAFSQWKPLDKTVSKRICQLLQRGDSSPR

SEQ ID NO: 3542 - protein, 114 aa, Homo sapiens
STITFVPYLKGSLPLPMNLDAKTKTESIKPFYMELPGNALWGSQNPTTLYCKLSRNQNRTTSKFWKNKLQSVSCEGKSFTTLRHQRMLLRTVGNKDISFCVCFCSPFPSVNGGL

SEQ ID NO: 3543 - protein, 31 aa, Homo sapiens
ISTVRTKDLQQLACSSPPSIESISFFSMETS

SEQ ID NO: 3544 - protein, 19 aa, Homo sapiens
LFLWERLSVRLPLGCMGKT

SEQ ID NO: 3545 - protein, 25 aa, Homo sapiens
ELGTDIQYSLFSTRLETRITCYKSS

SEQ ID NO: 3546 - protein, 88 aa, Homo sapiens
QLHWSSVTGSMFMAWCPQTSAGIPITLQYLIIIMNLLDLMNVQCTSPMSEDARAVITALSQRNESLRTGHGHSIFTFFNQTGNQNHLL

SEQ ID NO: 3547 - protein, 175 aa, Homo sapiens
CTAASAARRSGPRSSSSSSSNSSSRRRPPAARSRRRRAAPSSAPGSPRDRGHWTDTSEWRTTRKISNTWLSTGWFTMTIALELCDRINVYGMVPPDFCRDPNHPSVPYHYYEPFGPDECTMYLSHERGRKGSHHRFITEKRVFKNWARTFNIHFFQPDWKPESLAINHPENKPVF

SEQ ID NO: 3548 - protein, 64 aa, Homo sapiens
CTAASAARRSGPRSSSSSSSNSSSRRRPPAARSRRRRAAPSSAPGSPRDRGHWTDTSEWRTTSP

SEQ ID NO: 3549 - protein, 55 aa, Homo sapiens
HPVKISQKRWTRQFRKEESDFHEKQPKQKKTIKISQIQNQSVNKNFHIHLKRTYQ

SEQ ID NO: 3550 - protein, 30 aa, Homo sapiens
FLGFETKKNERKVKRERIYQCSRILDKPNQ

SEQ ID NO: 3551 - protein, 15 aa, Homo sapiens
KKNKFSGTYTRNTKQ

SEQ ID NO: 3552 - protein, 42 aa, Homo sapiens
TSEGCSEKSCCFKSHCFHAVKPRPEDSSGSTSDGRNFNAEVT

SEQ ID NO: 3553 - protein, 31 aa, Homo sapiens
SDFFMYFFLLHFLEKSPLEEWNQWVMHLCWH

SEQ ID NO: 3554 - protein, 43 aa, Homo sapiens
QWPSSPLNVVLMATGNAWGKKGELRKPTNPRPIEKWVGNKVKF

SEQ ID NO: 3555 - protein, 23 aa, Homo sapiens
WVHTMTFLTYFFQIAGVCLKTKN

SEQ ID NO: 3556 - protein, 105 aa, Homo sapiens
LPVPCAALLTTSGNPSTTPAAPPPPGPCFPPGPLPAHLTRPSPPTPSPRTHAHPHAGTPAPGAHQSLPRGTTRCPHGQPVLSHRPAAPHRSETAAAPDAAGTTGG

SEQ ID NO: 3557 - protein, 209 aa, Homo sapiens
LQPLQTAGQPRPSPSWCPRPQPWPAHLPPTRLPTPTCPSTAAMGPDKAYSPQLSPLQARTALTARTAASPMAVATASLPHPAAPTAPAMPHRLPGAPACHQARPPSSAALRGPPSLVQPPRPCAVTAGPAQSRPVATWYPRAPQPLPPLQPLPPPPPPPPSSPRPRTVGSLRGLLSGLSGRAMEAWTGPQRPLVSSTIPVLTATSASPT

SEQ ID NO: 3558 - protein, 88 aa, Homo sapiens
RRPAEGILAHLLAYTGLQGRAAATAHKAGCLRAPQAWTPGGQPGPRSCSPGPPELPGPAAGPAPLRFPQLQGHSLLVPSRLSCPQPAL

SEQ ID NO: 3559 - protein, 162 aa, Homo sapiens
SRSGKLWSCHPCNLLLILWGCRAWLSRPWTPCLTPWSRSCLTPRHSTPCPSCLTSQVAVWSPSSPWGTAHWPSPCAWTCAHRTAPPGLRVTPSTPCGALIGQRSCVAGGKPDGDARQTPDPRAAYCPCLCPRGWWLPWPNPHHHRLLHPLPCQAQARSQSQS

SEQ ID NO: 3560 - protein, 74 aa, Homo sapiens
KSFQETSRQKSNTYWKANSLCRETGGCLKMERWPRTPVSLYTGPLENSDSDKVPLRSNKSTQFVIQNRPSNLLN

SEQ ID NO: 3561 - protein, 66 aa, Homo sapiens
KELARGKHHHRKIEIKIFPGDVKTEEQHLLEGQLPVQRDGGVSEDGKVASDTCVTLHWPLGKFRFR

SEQ ID NO: 3562 - protein, 54 aa, Homo sapiens
IPMAPGSDMAQAPPALGGACTGTWGPRGEGPPSSPGSLWPESWGTRRKSPGAPP

SEQ ID NO: 3563 - protein, 103 aa, Homo sapiens [sequence omitted]

SEQ ID NO: 3564 - protein, 187 aa, Homo sapiens [sequence omitted]

SEQ ID NO: 3565 - protein, 80 aa, Homo sapiens
RDTMDCKVCLVSLVTMVIKVLLAPWVLLVLGALLVLLALLEKMVALDILVQLDLLAFEALRVTKALLAPLVPLALLDLQV

SEQ ID NO: 3566 - protein, 42 aa, Homo sapiens
CVRPRAPRPPRSPGPSTMSPSCGMAATAPTSTPCRTAPPSAT

SEQ ID NO: 3567 - protein, 85 aa, Homo sapiens
PWTLPASPWAFPTQGPPLPPPQPPYLRGLWPCQPPQPAQPPQPPAPPLLSHPPPPALPLRPPAPSLHEPGAHTPKWGAPGTRFSR

SEQ ID NO: 3568 - protein, 182 aa, Homo sapiens
PFPAPWGWWCPARPRAPPARPFDGTWPQGTTSTTCRTSGTSTPTGRCSSTPSPPPPSIALSTTMTTSAPRRTLPARSGAPTSASKQFSGNPTPSGWRIKGQCVATWPSSSASSPLQCRNMLALYLGRKTQSPSSQNTGFLLPTTAGCTSLTYRRRTPSPPIAASPSTSIAGRPGRAMGHASL

SEQ ID NO: 3569 - protein, 74 aa, Homo sapiens
AGSASSSCVCPLDLWCNPTTRMASTAKLVCSTARWTATPHPRSCGSMPRGAGTPSSTTLCPSLAASRSCPTARC

SEQ ID NO: 3570 - protein, 31 aa, Homo sapiens
ARSICDHKGFSSPVYKKKKYKTCGYEQVPLC

SEQ ID NO: 3571 - protein, 30 aa, Homo sapiens
RATSAAERESSSANSRSSIWSEDVRTSQLW

SEQ ID NO: 3572 - protein, 28 aa, Homo sapiens
NADQIQNLLSKKQVYLLLLNLDTHIVEI

SEQ ID NO: 3573 - protein, 19 aa, Homo sapiens
KIPIVVLLCGLFLKTLKSL

SEQ ID NO: 3574 - protein, 58 aa, Homo sapiens
TRRQQGASYCQHHPLWSHLLTMTMWKKLPRKESRNPPPQATHWSVSPPATLISPDTLS

SEQ ID NO: 3575 - protein, 48 aa, Homo sapiens
SLLLKIHLQSLLLLTLSRLMREGEHHSHFTIFLLLMMMTTSREMPSLN

SEQ ID NO: 3576 - protein, 37 aa, Homo sapiens
LMCQLLWAHTLSLYSLQPPQGSASRPLSAPLWRGFLL

SEQ ID NO: 3577 - protein, 157 aa, Homo sapiens
EMAAVRAAVEKASTTGRAPVALVTNPVTVVAPVAPGVLPVLRRQCCMMGNACLNALAGTMLMPLAGAKFVITHVPAALGPHPLTVQPAAPPRLCVKATVCPAVERVSTLTMESAKPVTPPAWLVWVPHPLTVLGVRSQRKDCKWSSCLTWASPLASV

SEQ ID NO: 3578 - protein, 45 aa, Homo sapiens
GGTEKLLPVSEQRGCAEADGERGWPPPGWHLPRQGQHAEPRPRPW

SEQ ID NO: 3579 - protein, 241 aa, Homo sapiens
WGKGLAPPWLAPPEAGAARGAEAAAVVTAAFTKEASKKAMGPLDEAPGKSSAARAGMTEARGGLRSQQGGMEHDVALRREGLAQGRSTPAQTARTGAPYGRNRRRRRRAAGGSEQGPGETATAGAPPALMVVPALLAGGNMGNGGASLNLICEGIEEGVVKRRGGEGEAALTCGGAERLKALRRTRMGSQSGAWTMRMKKWAPLMPLGPSCLSRRAPRSPFLRSRSWTSKGWRRRRNLPKG

SEQ ID NO: 3580 - protein, 49 aa, Homo sapiens
KKKTNYTLEKIMPNMSSLKTQCIFFQSIWYLLQLKPMVKYPPHRFCRCF

SEQ ID NO: 3581 - protein, 60 aa, Homo sapiens
EDLVYIFLLKEHQRNRGICSFSANLAIVIFMCHWQAKKNMEHRLTMDSALSLTKREGPET

SEQ ID NO: 3582 - protein, 106 aa, Homo sapiens
CWMRGAHAQHLPSSTPALYLVPFCRTPTSSSRLSQRQIWALALTGPGAPSSLTSQKTLHPLRGPGFLPPVMAGGRRAWHCSKKSRPVQGGMARPGWPWPQTSVTSA

SEQ ID NO: 3583 - protein, 78 aa, Homo sapiens
WQEPPRHCLWLWCRPSWKGKGASAPRGPGMPNSLNQGIPGRYLTGGLWAWKAGTGAQRVCCLRCCFSPLKKVWNLQGL

SEQ ID NO: 3584 - protein, 76 aa, Homo sapiens
QPPRHCLWLWCRPSWKGKGASAPRGPGMPNSLNQGIPGRYLTGGLWAWKAGTGAQRVCCLRCCFSPLKKVWNLQGL

SEQ ID NO: 3585 - protein, 36 aa, Homo sapiens
VQCQILELNPMNNGPFKWKKKLQKKEIAKNVFVQNI

SEQ ID NO: 3586 - protein, 29 aa, Homo sapiens
TMGHSNGKKSCKRRKSQRTCLCRTFEEVQ

SEQ ID NO: 3587 - protein, 11 aa, Homo sapiens
KTIDSRKKTNQ

SEQ ID NO: 3588 - protein, 59 aa, Homo sapiens
QRMMKSSSSPIAQSTAHIGNPRRVLARGLHRRMGPLSVPPGIRWSPLPALSRTGRRPTG

SEQ ID NO: 3589 - protein, 13 aa, Homo sapiens
VFPPESAGALCQP

SEQ ID NO: 3590 - protein, 50 aa, Homo sapiens
KEKKRGRKKGYRNLRKAIEKKEVWLVKRIIQTLTKRRKKKRVFRKEKTMN

SEQ ID NO: 3591 - protein, 37 aa, Homo sapiens
KEKKRGRKKVWLVKRIIQTLTKRRKKKRVFRKEKTMN

SEQ ID NO: 3592 - protein, 37 aa, Homo sapiens
MFLIVLLFLRETHQFSRISLMKVTPLSRRYTDPPEGA

SEQ ID NO: 3593 - protein, 68 aa, Homo sapiens
GVGYQRFSKVHSNTNVFRSSYSWRCLFCKYQSNSSYSFWREPDQSNCPKPNWHLPLCCFWKCCQDVGS

SEQ ID NO: 3594 - protein, 231 aa, Homo sapiens
LRSGSHPPGQGFPRQPPGWRFVHVPLATRASSVNPVLRDTRGRCHRGVPMPAVSPAPVTSMAPVTPTQGSVSAATIPRAHPVNAVCQVSMATLSRAKPTTASPVPALASRPVRPSQRAGRWCVPTAPRAREGGAVRSVMMAFLGTRWGSLGTPSPATSASVAGTWTPMPWATVTPCLATACAACTTPRVTTVSTVRKASTGAPWPLDPQTNACLAAVTHRARSVSRCPATQ

SEQ ID NO: 3595 - protein, 29 aa, Homo sapiens
TFCWERPQGGTSTRAITCFQGLGKPSWSR

SEQ ID NO: 3596 - protein, 57 aa, Homo sapiens
FILCYFYLYPSVGPRKFITFFVKSWLFSNLPVQIPTSMRTWSWPEQFLGWWDPCPQL

SEQ ID NO: 3597 - protein, 55 aa, Homo sapiens
PQPPCCPLTPHDDRTKQLEYRGPQPWPPRPWHEPRAAGLLRFSFLCTAWSPGLWT

SEQ ID NO: 3598 - protein, 102 aa, Homo sapiens
SSTRSSITSCCITHTPCPSPAVTTSSHCPCLLRRKRKSPHLQFLRNQKGSPLSCQIREKPQQMKKRKQKEGSARRNLAQELMNIHRATYTECLLITRLSPPK

SEQ ID NO: 3599 - protein, 26 aa, Homo sapiens
VPPNAGVYGWWPPSSPGCQLLCKEEC

SEQ ID NO: 3600 - protein, 19 aa, Homo sapiens
HDSVFPWRTSCSMSHFPLF

SEQ ID NO: 3601 - protein, 82 aa, Homo sapiens
HETEWNKDIPKFLRTQGCMVGGPPHRQVANFCARKSAESRWGRAGEGTALGFFFQKGKGQTETEKYVSFESTTLPLTGTYLP

SEQ ID NO: 3602 - protein, 117 aa, Homo sapiens
PACQRTWIALERRLRRTLLCVPAASLSSQTRTTSTPTAPMWASICIMGPAGPAQAASGASPPPASRPPPAASLSLATATTAPARLAVLPQTLISAAGPAAAQRLPSAWRTTAPLAPP

SEQ ID NO: 3603 - protein, 200 aa, Homo sapiens
ALRTTETITITAMGTPTQRGEKPQCHPPTAAPSCSPLLTRLPLPHLGHHLSGPSSSGPREADLQLRYLLPALLLHLRLLLPPPWSSPGVAPVRPPTPTWGYWCTAGCTLAPAARACLHPCTWPRGRESTTWLAGCAATRVEEAWPTPLMPTGWGHSCLACSRRTRRAPPLRPAPPPALHPLPPGFGVKAAATAPCASRAK

SEQ ID NO: 3604 - protein, 101 aa, Homo sapiens
SRKCACPSTDRPGPGPGGRPWNTGRARENPRTQRRPGLCPHWPPAGTWTCLPPNAHPPPGQEVQAAAEAFPGHPLCRKTPFSSSWALCHPPPSSLRIQLLI

SEQ ID NO: 3605 - protein, 334 aa, Homo sapiens
SASQAAVATAACGRAPGHSAKRPRPSTGSQKSSSSRRPRSRAANRPQWTPGCSARAPAWAPANSPSRRVPRSCGLGAGSGGSPAAAASTRQASPWASCPSRTRPHSITRAPASRCTGLRASRTWASIMTITATATTTTTGSHSTATRSRNPTWRASAPTARPGHPTATTTTGTRPRIPTTTTTPTITVAPLIRGTPTATATTITNPHMRPRRGTRLLTATTMGTRARRTLMATTWIPMRRTTRHTHPMTSHTTLPTMYPTLIPTESTTPSPMPKASMAVGTRPSTPPRCPIFTRRSRLRPLCTPGYHRPSRRPTTRMPTPWMTSPSWRNQRTRA

SEQ ID NO: 3606 - protein, 101 aa, Homo sapiens
CTRTSEAWTSRSRRCGRPWSSRSRISSSTSRSASIPPEASSCMAHLAVGRPCWQRRWHITQQLHSSGSWARSLYRSIWVRAPAWSGMCSAWPRRMHLPSSS

SEQ ID NO: 3607 - protein, 177 aa, Homo sapiens
AKEPEKGISPCPGGGEANPKHPAGHRTISGGCGSEYSHRGLYHRLQLLCAHPEHHRSGAAQAQRLSGPPQAQQCTGGRAAPRSRQQHHDAHLRPEARCDVRGHRRHGHPEAGGAGGRGAPAHAFRALQADRHRSPPRRPHVWPTWLWEDHVGKGGGTSHNSCIHPGRGLGVCTEVSG

SEQ ID NO: 3608 - protein, 175 aa, Homo sapiens
GPGGPVQPLQGGGEANPKHPAGHRTISGGCGSEYSHRGLYHRLQLLCAHPEHHRSGAAQAQRLSGPPQAQQCTGGRAAPRSRQQHHDAHLRPEARCDVRGHRRHGHPEAGGAGGRGAPAHAFRALQADRHRSPPRRPHVWPTWLWEDHVGKGGGTSHNSCIHPGRGLGVCTEVSG

SEQ ID NO: 3609 - protein, 149 aa, Homo sapiens
AVRWGRRERWLFSPRRPAPAASPASGSGTTACPQGDADQGGPPAAPTSASGAPRTLACPSRDQKHPRNSPGEEGHHARTRQRSGRSHGPGAPDAKQAEPAGGGVQAPALRGVCGGAVLVHHGCPAEEPADVSGTHSEFTDASSATESHS

SEQ ID NO: 3610 - protein, 54 aa, Homo sapiens
PGGASSSPHICQRGPTHTRLSLQGSKASKEFTRRRRPSCTDEAEEWPVPWAGGA

SEQ ID NO: 3611 - protein, 185 aa, Homo sapiens
EFQVNQDSRAIFFWNSEVPLHHHRLLPFLTVAILFLLRVLYHSLSQDQHLISKDSSQCSQESGPYDQPCSLQVRWGFCTLASLGRQPHGPSFLLDSRSCQAQDSRFCPHTHSPTCRGRCILHCPLRISLSLSNLSNSPRHSTSLRTSPRTSPRPSTSPHPSTHHSTRRSTSTTTTTTTCPSRPLL

SEQ ID NO: 3612 - protein, 64 aa, Homo sapiens
NRRSYGGSSRLVPGRRSCWRDSRSNSSSCTLPHPQQSRKSRHCHHHPPTVTHCCPFQVHRSDKM

SEQ ID NO: 3613 - protein, 56 aa, Homo sapiens
KEVIFMPVHSSGEPFLFISWMMMNQKEKNSQSEMATSIMDKQSNLCAQLLAWHSQD

SEQ ID NO: 3614 - protein, 30 aa, Homo sapiens
KMLTYALPQEQRWLCLIDYDPRQLVPDTCM

SEQ ID NO: 3615 - protein, 64 aa, Homo sapiens
KSEGIKQYLFFMQKLHRSHMEMKKGFFAHLLVYILWAVDGRKKKNKWNAMVVLNKSLNRVHLLG

SEQ ID NO: 3616 - protein, 195 aa, Homo sapiens
VKTLAHLPAQSLRLSPRARRLRHRVGASRKPRLLAGRKTPKRTTRSPRCISQRTHCCPGMTGRSRRGSLRPPGPCQAGGSGSSARTHLTTKSTSRSPSCPSPRPLWLCCRACSLMGRALWLPGAGTMAPTHPGLLGPRRRRRRRKRVVLRRRRKRRRRKTGLKRKRPALRRRTRRGPWFLRPLSRECRLTRPITC

SEQ ID NO: 3617 - protein, 150 aa, Homo sapiens
SSPAGRCSCVEPMPFPPCAPADRWGTSAGLLRRSMVWPAAPMTHATTPQLSSPPRGSSMQPRSSTSQVGTLPSTAAWAVGHRFALPNITPSGLMSQTSWQPMILGCLHTSSCGRTQWSTTVDAPCTLAWPACARMTWGADSCWRTHGPHS

SEQ ID NO: 3618 - protein, 130 aa, Homo sapiens
WCLQAPWLSRCCCPASHCWCPTSPAPRMSPVSPAVSSSCAPLASTPPWPLKTCSRGSLTSPTLEPGISPSWLWTPPGTSSSWEPGTTSSDSALPMSLFFRPQSGPPVRTRAAPAKAKGRLRRSVRTTCES

SEQ ID NO: 3619 - protein, 198 aa, Homo sapiens
AGAGPPGARGRPAPGTASWASASARERALTRSPATGACPAWAMLPSTRTATPRLAQFGVLGPAGPHGLHAQLPVVGVTINAPVPAPAPHPPQVRTSVSGCTRRRHYVPHRPAQKAGRPGLSGVSALTTEPRAEAGTVRSSSQGPAPVLETAARAAPAPTARFPSSCQPPAWRRPPTVQGSISSTWWPRASPASWALGS

SEQ ID NO: 3620 - protein, 162 aa, Homo sapiens
AGAGPPGARGRPAPGTASWASASARERALTRSPATGACPAWAMLPSTRTATPRLAQVRTSVSGCTRRRHYVPHRPAQKAGRPGLSGVSALTTEPRAEAGTVRSSSQGPAPVLETAARAAPAPTARFPSSCQPPAWRRPPTVQGSISSTWWPRASPASWALGS

SEQ ID NO: 3621 - protein, 156 aa, Homo sapiens
GAGFSHWSGVFSPVCLPELGLQRGLSWCLQAPWLSRCCCPASHCWCPTSPAPRMSPVSPAVSSSCAPLASTPPWPLKTCSRGSLTSPTLEPGISPSWLWTPPGTSSSWEPGTTSSDSALPMSLFFRPQSGPPVRTRAAPAKAKGRLRRSVRTTCES

SEQ ID NO: 3622 - protein, 18 aa, Homo sapiens
KWNGKLKKEAKEVFPKML

SEQ ID NO: 3623 - protein, 78 aa, Homo sapiens
RITSPIFLRKFPLKKLMADLLPVQEPMKRASKEVVGKRKTKLKLYHLNLKYNLEANKNFSFLMKKKKLEKTTPSSLAQ

SEQ ID NO: 3624 - protein, 144 aa, Homo sapiens
KWGRLWWRQKWGWLWWGQRRRLWWGQRRRLWRRPRRWLWRRSRWLWRRPRWRLWWRPRRLWRRSRRLRRRSRRLWRRSRRLWRRQKPGGLWRRPWWWQWLRWRPKWRLWRRQEWWRLWRRPRWGLRRRPRWLWRQNGRKKRLQK

SEQ ID NO: 3625 - protein, 53 aa, Homo sapiens
IFIQTRTQESQRGRQQCHLMTLLQLRQPLTGLMEKNSMATSLKCPLPLEDLNS

SEQ ID NO: 3626 - protein, 276 aa, Homo sapiens
TLLEGIPAISAMSLDQRTLVPQEEISGGEATVERGATEVVGAEVETEAAMVETEVGVAMVETEAAVVATAEIEVGAAMVETEVGVAMVGTEAAAMVGTEEAAMEETEEVAMEEIEVAMEETEVEAMVETEEAMEEIEEVTEEIEEVMEEIEEAMEETEAGGAMEETVVVAVATVETEVEAMEETGVVAAMEETEVGATEETEVAMEAKWEEETTTEMISATDHTDDCFECSFVSDMIHSEIARVLPAAFLVASSWVVKLSDIWIFIWVGGLGQFFF

SEQ ID NO: 3627 - protein, 288 aa, Homo sapiens
EAWSWANARRAAQPAGAELCAEQGPAVQPAWGHPARLQPLPRSQVPARGVCPQRPGCAELPGAQVQGGLASQHCHHRGLPEQVQRRLLLPAAAEAHDVGAQGRLLPPQAHSPAEPHGRLCAVPSAAAVQARDAAFREGHPGLHRQPDPARHLVRVQGQVGHRGRPGGDPACARRVPAQGRLQGPAHGEGGARHERHPQHLQPRAQVPQPAHLPGLGAPWGPAGCRAPQLCTHAAVLQHLQVLLPLSLQSGDQAGEPRLPAPPGGLSAAHQLQQLLPGRLRLLCGGRAQ

SEQ ID NO: 3628 - protein, 48 aa, Homo sapiens
TGRGQSGASRRWPTMLFSQIFFKMRLNSCSLTCQNYQRETRSSCCPLT

SEQ ID NO: 3629 - protein, 46 aa, Homo sapiens
LPPGHGGTPTGTCLTPASGSGRMCQMWLPPSHGGTPTDTYPMPASA

SEQ ID NO: 3630 - protein, 232 aa, Homo sapiens
GSLCQMWLPLGHGGTSMDMCPTPASGSGRMCQMWLPPGHGGIPTGTCPTPASGLGRTCRTWLPPGHGGTPMDTCPMPASAWGSLCQTWLPPGHGGTPMDTCLMPASAWGSLCQTWLPPGHGGTPTDMCLTPASGLGRTYRTWLPSGHGATPMDTCPTPASAWGSLCRMWFPPGHGGTPMYPSLRPTWCWGLSHQKLSPTHPGPNRAPLATRPSQRSAWEHRALCWTVGHGCL

SEQ ID NO: 3631 - protein, 84 aa, Homo sapiens
QWGLVAGGCSRRRGPDPSLTASALETSYLWAQGLSRPCRLAWSLSWRWRCRPLTWTCPPQLLGRHPQQPALSPPGHRSTTLVLS

SEQ ID NO: 3632 - protein, 74 aa, Homo sapiens
GYPVPQPILLRAQASLLSFRSHDLPAAGEEHAHCLFTELSVRRGLFPVCNPCLRIPSERGDCPGPIELCICLAV

SEQ ID NO: 3633 - protein, 13 aa, Homo sapiens
KNAFLLMKPVRNQ

SEQ ID NO: 3634 - protein, 77 aa, Homo sapiens
VHQNRIQIQGYAVELMKTLMIKTHPFGNGHFANIKDILLISLIFHGLKTTFFFLLQWIKQSDYGTFLEENAFAVFNI

SEQ ID NO: 3635 - protein, 11 aa, Homo sapiens
KMLLTISTICE

SEQ ID NO: 3636 - protein, 78 aa, Homo sapiens
RAAVMPPTDVSPADSSPGLPQLPHHPWWQRSPRRGQDLAVKGSGLKTLGNGPDDGAPHPSSTDGGLCEAPGLPTSSSL

SEQ ID NO: 3637 - protein, 27 aa, Homo sapiens
APGRSLQPGSIFLSLPETALKQYACTV

SEQ ID NO: 3638 - protein, 66 aa, Homo sapiens
TSSAGGRMGRTWARAASSGTCGGHTAPSCCRRTGARASRHCTPPLPLCCLPCCRRRGSSALCPRLQ

SEQ ID NO: 3639 - protein, 52 aa, Homo sapiens
PPISVSKGHRPHHQRIPCQRPVGHRGLPTRSHVSCVPRLCPPEVQRENTGSG

SEQ ID NO: 3640 - protein, 128 aa, Homo sapiens
NLGRQLFEKFFSYPSRTGSAKGGDQAEQERDRLLVLGEAEASRQHGTSCLGFHGVWQKRPRCGSPQWCSVSTRPALRCPVNKFSAQPFASNCKKSRTGSSPEEHVCKNPVAYSPGVRPVSGQDWPGPN

SEQ ID NO: 3641 - protein, 40 aa, Homo sapiens
LPKLPPNPSVHTSLRCQSPHPRWPTPRSHQPVTARRQRSR

SEQ ID NO: 3642 - protein, 37 aa, Homo sapiens
QGKQQNPWPRAQRTGVMWFHNITRTPKSSAKRTWRSW

SEQ ID NO: 3643 - protein, 36 aa, Homo sapiens
SQKKTNKITVTRKTPQVIIWIIPFWFPFKFKKEIMY

SEQ ID NO: 3644 - protein, 168 aa, Homo sapiens
MRMRMKMTLISQNIILMPVKKKIVIKRNLIDEVAQSLDLHIHDLHHAHPPPQVQGLGPGPVQEVLPVRSQDLVPVPENVRDLVGRNQDPAPGPTGALLPHEKDLIQVHHLLLRGTEREVVLDLLHLVIAKKDEQDHGHPKDATGHHLDHPILVPVQVQKRNNVLKFTS

SEQ ID NO: 3645 - protein, 35 aa, Homo sapiens
KNRGSCTAERISFGFIFSVCHLTSCFKEQTKKHIQ

SEQ ID NO: 3646 - protein, 17 aa, Homo sapiens
KYLLHLKNVQFQWKLNG

SEQ ID NO: 3647 - protein, 16 aa, Homo sapiens
GADKKTHPIRTSLKMN

SEQ ID NO: 3648 - protein, 57 aa, Homo sapiens
IGLRIRWPFSGRSSLWSEPTATGCSSGCPGTGPPCCGGCSPACSLSEAHSREKMMRR

SEQ ID NO: 3649 - protein, 52 aa, Homo sapiens
DCESGGHSAEEAVCGASPQLLAAQAAVQERGPPAAAAAVQPAVSAKLTAERK

SEQ ID NO: 3650 - protein, 103 aa, Homo sapiens
AACCGTAAAFLLGRRGQVAGPRQQSPPGPGGAAERAAGHARPHLRYEVQRLPEQAGKAAQKGNCPSPKQAEPAAQPAPAHGARLGRLRRGRSCAGAGGGRGRR

SEQ ID NO: 3651 - protein, 98 aa, Homo sapiens
NPANFSSARDQNLFVCSPSEVGDSSAAKEKVAEHMRRLRGGGGVPRKAPGRRSHQRLWGCEERAGAGRRPGEEGHTPTTLCLRVQHLLQQQPALRLEL

SEQ ID NO: 3652 - protein, 183 aa, Homo sapiens
AACCGTAAAFLLGRRGQVAGPRQQSPPGPGGAAERAAGHARPHLRYEVQRLPEQAGKAAQKGNCPSPKQAEPAAQPAPAHGARLGRLRRGRSCAGAGGGRGSPSEVGDSSAAKEKVAEHMRRLRGGGGVPRKAPGRRSHQRLWGCEERAGAGRRPGEEGHTPTTLCLRVQHLLQQQPALRLEL

SEQ ID NO: 3653 - protein, 147 aa, Homo sapiens
TMTLHPAHPPGARTPAPPRSRSLCPTRWQQRVPRPLQPWPAGRRRAWLFLPSGAGSLLRWRGSTSSTCPKAPHPAPARSWSSSRLQKVSIGRLCLTASAPRPRQTPRQGVNPQESSAAWGPPQKRTRIWLGTATMTAAALSCSMPGS

SEQ ID NO: 3654 - protein, 99 aa, Homo sapiens
LSKPRPQAQRQRLLPRHCGAWRFPHGLGLRGSRSPCLKSASSRDWAQLPLCPRPRTARSPAPRVSPQPRSRSPLRGLWWGPGGAAPARALVPRWTTRAL

SEQ ID NO: 3655 - protein, 132 aa, Homo sapiens
RIIKNIHLRFHCLRNFSTKCFKEILVSVYTNHYCLFLRKRTKKKRIKKAKKMREKIKKKKEMMKLMNQNPNGENQAMIKIKKKIEMKGRKKIKEKMILKMMMKLKKITIKMNMTLWKQKKLRMKKMIGMRKK

SEQ ID NO: 3656 - protein, 24 aa, Homo sapiens
CATTVTATPANPLNTASCCTAYKP

SEQ ID NO: 3657 - protein, 64 aa, Homo sapiens
RLLLLYFSQLHHRQHLVFRLSPSPSHCCRHRFQQLLLHHYCRLNHSPYYSSLSKKLVYCSLLFV

SEQ ID NO: 3658 - protein, 282 aa, Homo sapiens
LAPAAATVLRPCWWTGPLVGELAPRLPLWLPLPLAPQSARAVRCCMSAPNQPLPSPPAQQAPQTLPGPPGLAQLPLPPEVPPGSHLCVETSSWTIPWTGACPAVAVEQAGGSCRLQLRSQDPSPAGMGSSPCSPAHHLCMQLTATAPSSAPRTPTPVPPALSPVACPQRLPKALRCIQTLCCGCPHPPVSPRLVNAVATRTWLWRGCGTGTSGTRDWLRGPSAGLCSLPWARHTHPSSMPAAMRWARRCTGPPARRHSHTRGVSRRPLSLADTTRTSCIPRS

SEQ ID NO: 3659 - protein, 280 aa, Homo sapiens
LAPAAATVLRPCWWTGPLVGELAPRLPLWLPLPLAPQSARAVRCCMSAPNQPLPSPPAQQAPQTLPGPPGLAQLPLPPEVPPGSHLCVETSSWTIPWTGACPAVAVEQAGGSCRLQLRSQDPSPAGMGSSPCSPAHHLCMQLTATAPSSAPRTPTPVPPALSPVACPQRLPKALRCIQTLCCGCPHPPVSPRLVNAVATRTWLWRGCGTGTSGTRDWLRGPSAGLCSLPWARHTHPSSMPAAMRWARRCTGPPARRHSHTRGVSRRPLSLAGMGGAFTDG

SEQ ID NO: 3660 - protein, 64 aa, Homo sapiens
FCTQRAAPSQSLGPAMTTRSPMAASLWPSAPHHPRLGTSCGQYLGGALSGEPHGNHLHQIFMGI

SEQ ID NO: 3661 - protein, 64 aa, Homo sapiens
SLVNGPSWSAGGPPQPAPTLHRTPTKHTTPCALLRSWLLRPWNARCQCNSRSRRPPAAWPWPLI

SEQ ID NO: 3662 - protein, 117 aa, Homo sapiens
DFSSGTPTSRTSLTSLLLKFIASRNSSLRRSTWRMRTATSRRGGRSALGTFAAATPPAAAPSPTAPGTATGRSCTALPSRSESTASWFDSLHEELKRIRSQTHTAEKPASCSQTGKV

SEQ ID NO: 3663 - protein, 108 aa, Homo sapiens
LGGRRGAPGSTRTTPGLCWSPVASGLESFPQGQRTACVTPPWAPATQKPRRCISLLGTRWPWMCPQSTTTAHSFATPCPCWATASTGTSSRTVRRNGGWVLPDTTFQV

SEQ ID NO: 3664 - protein, 38 aa, Homo sapiens
ISGFKCPGQTQLFFFADAEESIGSLCDICSCQECPCCP

SEQ ID NO: 3665 - protein, 29 aa, Homo sapiens
RRKKIKGFSVFFNAVRKSETKLQVPLQPL

SEQ ID NO: 3666 - protein, 20 aa, Homo sapiens
DFTSRVPPRDLQGPPGHPEQ

SEQ ID NO: 3667 - protein, 166 aa, Homo sapiens
REESARRQKGEQRSIRRQQPMSVRPVSMVPGTAMSHLLPLAPREGKVSGACLVHQAPRERREHGAMTVFESPRMPHFSVQKARRERRGSQELWDPQDSQAQQARRARKARRATEASRACRESQAGTAGQERSVSLGPKGRRETLALLGLRGWQESLGPPASLDPLG

SEQ ID NO: 3668 - protein, 255 aa, Homo sapiens
LRRGHRCSLSQAPQDLLEPWDPQDLQVPQALPAQLVSQDIKKFLIYKVPQAHPAHAGHQGLPFQAHQDPEAHQGRVCQAHQAHQDRSCPTQKPSSPAPQAHLAPQVPRETKVPQAPEDTKASKASQVSQPQGPVLSDSTFRDHQAHLAPRDPKVTKVIQVFQGLLAFLVVLLKGDHQVPCTCQARQGPLGPLGLRALSAALARRFSSTSLSTCRVTVLDLTYPEFRVPQAHLVPQDLSPPSQARLSTTQSWQATL

SEQ ID NO: 3669 - protein, 88 aa, Homo sapiens
LRTSWTSSKLMEPFKDPLGKKERWALQDPKVTGALLGHQVILGHLALEDTREKKETKVTKSMLGGEGEEVLLSSRELAMAGQLLDQVS

SEQ ID NO: 3670 - protein, 13 aa, Homo sapiens
KKKSKLPTMLTQA

SEQ ID NO: 3671 - protein, 92 aa, Homo sapiens
MTERGPRRSGGGGNGSQNPVASPPGKPLWKRGTQGERSILGWRLKRPRVKLSDARSARERGSSSRAWSVRGFLWGPVSWIWGRAQCMMWRSW

SEQ ID NO: 3672 - protein, 54 aa, Homo sapiens
RATPVPGAPASWESAPLRSLCPQWLWCTCVRSTALKIWLVLISPLMCVRDTLCW

SEQ ID NO: 3673 - protein, 21 aa, Homo sapiens
RTLGPPWLPDWFASTPGLTGS

SEQ ID NO: 3674 - protein, 192 aa, Homo sapiens
RFTSLSLGTLSSSTTAQVLESHPRTRSPGLVGIRPTPLPVSPMALRCCSPIQPTASFWPLTPVPLEARAPPHPPGPNPPTPRPTVGTIWSLRSQAPRFCPHLPRTASPIMPRLTLLPCRASPGATPMLCLHCPQGQSGMGPPEWISLDLDSASRRSLARASLGRCTCVRSTALKIWLVLISPLMCVRDTLCW

SEQ ID NO: 3675 - protein, 155 aa, Homo sapiens
RFTSLSLGTLSSSTTAQVLESHPRTRSPGLVGIRPTPLPVSPMALPTVGTIWSLRSQAPRFCPHLPRTASPIMPRLTLLPCRASPGATPMLCLHCPQGQSGMGPPEWISLDLDSASRRSLARASLGRCTCVRSTALKIWLVLISPLMCVRDTLCW

SEQ ID NO: 3676 - protein, 32 aa, Homo sapiens
KKLRNKWMIGWKTGTEHRKNRHLNGQKRTSAN

SEQ ID NO: 3677 - protein, 30 aa, Homo sapiens
VEKREKRKKRLAARVWMYQNSVLQKKMKDC

SEQ ID NO: 3678 - protein, 62 aa, Homo sapiens
SPSERTQRGWQRRRSRRETPVSRRPGPLMPGLGGGSQPGCWRLQRSRSQRRSPEPSGRRTLT

SEQ ID NO: 3679 - protein, 125 aa, Homo sapiens
IIAPQVGRRRELVGRKKKTVGVTTRVLAKTRTIPQSRKKSPRRPCLTRMRRKKKNFLSLCGFDALIQKTTTPVTPWIRWEILQWLERVGFVTYMTNLRRSWGAGKKRPKLLGLRGNLQRRSSMKI

SEQ ID NO: 3680 - protein, 214 aa, Homo sapiens
NTMMTTGTEITVMGEVRGIGPWIGGSEAAVPTGEDKTAGTDLIMTEGEHHLATAATNGAESENGRDTGIETTEDHHLWKGPTKKSIRDLEVAPQVGRRRELVGRKKKTVGVTTRVLAKTRTIPQSRKKSPRRPCLTRMRRKKKNFLSLCGFDALIQKTTTPVTPWIRWEILQWLERVGFVTYMTNLRRSWGAGKKRPKLLGLRGNLQRRSSMKI

SEQ ID NO: 3681 - protein, 79 aa, Homo sapiens
CPLPPCLIPRPLQSCRSRLIISTLRAILTTTSHLPVLIVSRTTLVLSCPVLITAVVLISDISLHTHSQRLPVREGPQKG

SEQ ID NO: 3682 - protein, 67 aa, Homo sapiens
GCFTLSSLLCNINMNLQVPLPPLSQTLQPPIFSLHDQTLYPSPHPCLRQRKALFPPAQSGRLSPTTR

SEQ ID NO: 3683 - protein, 130 aa, Homo sapiens
TQEAYQDPLAAEGQESRQKCCGLFGHLLSLFLPVPGCYLLPVPGYYLLSIPGHHLIPIPCAHLLLLSRLLDLPIPCAQWLPLPVGGHHVLLCSPCFPGPGQQLPFLSCHQLLQRLHRAFGHDSNLFSQDN

SEQ ID NO: 3684 - protein, 226 aa, Homo sapiens
RPSIPATSPSSSNPAACASTPTGPARRPPTNALTLAQWSPVIAASPAPTSSPATSASTQARSPSSAASACATSAAATTSPPTSAPTQAKSPSPATSVEESLPGAMNARGIPRSTCGRRTRKQTKVLWPLRPPPLSLPTRPRLLPLTRPRLLPLIHPRPPPHTHPLCPPPSPLPAPRPTHPLCTVASPPRRWPPRTPLFPLLSRPRSAASLPQLSPTPSAPPQGFRT

SEQ ID NO: 3685 - protein, 202 aa, Homo sapiens
LPTTCWRTSSSTAGWAGGSGHGRGHWGPWTWGVPLPRSLLRQPVQLRTEPARSSCISTASTTESTPTASSAMAVTRSSRGCWPAPSRPTASTPAGRGAFPPKCCSGMCTSHHAPWPSGPRTSTAVPGSACQGAVTPTSAEIWFLGSSASPPAPSPDALSMGSSSPQWLGTLWPSLPSSTLWTFCGLRWGCPWPPCSSWRQPQ

SEQ ID NO: 3686 - protein, 121 aa, Homo sapiens
GPPTPPHHPARQCPHCIMHLQTQLIHRNLTGPSQLTSLHRSPYQIAATPWTTDFAASFLNPVTPFLLCRRCQGKDVLCTNARCLSQTSPSHHKALSRSTTTQCMNTTPWLAVRPAKAFPLL

SEQ ID NO: 3687 - protein, 36 aa, Homo sapiens
SEATSGNEALQPPHTIQHASVPTASCISKLNSYTET

SEQ ID NO: 3688 - protein, 104 aa, Homo sapiens
KSRKNPTVHVQKSALPAVKNSPLNSAMEKSACTMSDFAASFLNPVTPFLLCRRCQGKDVLCTNARCLSQTSPSHHKALSRSTTTQCMNTTPWLAVRPAKAFPLL

SEQ ID NO: 3689 - protein, 64 aa, Homo sapiens
GKKASWLIPAEQKAVCLKRAPGSFMMTPVLSQKNSMETSNKSQECIGKDPHTNGEDHFSSGSFW

SEQ ID NO: 3690 - protein, 63 aa, Homo sapiens
LNRNPEILHMTQAVCLKRAPGSFMMTPVLSQKNSMETSNKSQECIGKDPHTNGEDHFSSGSFW

SEQ ID NO: 3691 - protein, 35 aa, Homo sapiens
AGTLPRTNRNQCQACDIQSLPRPAVIMAVSAFKQQ

SEQ ID NO: 3692 - protein, 31 aa, Homo sapiens
RPNMSPPGRSLSPAKKTKSTRKQEQRFRKRD

SEQ ID NO: 3693 - protein, 55 aa, Homo sapiens
IQMQRNMEGIRDWTTALTFFLRLLNIMGVPILFWCTFQAEWPSSFRMWICRIEEA

SEQ ID NO: 3694 - protein, 42 aa, Homo sapiens
DGGWKNIALMDFVLMVLRPCFIITMEWVKVSQVITVNISDYK

SEQ ID NO: 3695 - protein, 35 aa, Homo sapiens
ENSSKKRNAKNGRIDEKISVCVIFLLPYKQQMKRK

SEQ ID NO: 3696 - protein, 23 aa, Homo sapiens
PWKKYRVLADWNNFVRNFQKRNE

SEQ ID NO: 3697 - protein, 87 aa, Homo sapiens
KKPCRNAKRMGGWNRSLGKGSVAPSSSVFPIIPAQEFCFRRKSQMILEMRMKMKMSHQKKTLRMKSRHLREGCRRKPQPSPQGRPHL

SEQ ID NO: 3698 - protein, 14 aa, Homo sapiens
KKQFLPGLPFLPAS

SEQ ID NO: 3699 - protein, 125 aa, Homo sapiens
TLSAIKPQVTMGKELLYSQGRLTAPTSSHGTRNTPVLRRRKTSSAVPPTGRSAMTCPRWSAMQNQSRIGKLWMAVRRKQRRSIFSLIFVTECCRKARHEGVPRTRQCVQWIKMEVKIWENLFPLP

SEQ ID NO: 3700 - protein, 31 aa, Homo sapiens
TSRGGTLAIRFISAPQPSSSTVTAAPSGQYF

SEQ ID NO: 3701 - protein, 57 aa, Homo sapiens
KGRRVSKRRMARKKANRKHKTSWVGFSINTKNQLSQLSRHPGPLQKKVHLPFLHRKM

SEQ ID NO: 3702 - protein, 54 aa, Homo sapiens
NSNQLLFLAHQHLQLCPPWLTGLPLLYNLCLHLLILQPHCQRVLPLVDLVQGHN

SEQ ID NO: 3703 - protein, 47 aa, Homo sapiens
YLLFPQQLCPPWLTGLPLLYNLCLHLLILQPHCQRVLPLVDLVQGHN

SEQ ID NO: 3704 - protein, 35 aa, Homo sapiens
PLQQPSRSFREKKLPRLLPHTPPPAPSSSLSPLVS

SEQ ID NO: 3705 - protein, 27 aa, Homo sapiens
EKNLKLPRLLPHTPPPAPSSSLSPLVS

SEQ ID NO: 3706 - protein, 50 aa, Homo sapiens
DGVPSGVGMRWKRCKSKPAVFLLMTSRRMIHSFCMPHCTPGITAGLSQET

SEQ ID NO: 3707 - protein, 38 aa, Homo sapiens
AQGTLMSRCFWQTAVASGTSRGCFLLKQCLHRIPKQRI

SEQ ID NO: 3708 - protein, 28 aa, Homo sapiens
CGTTRPVCLMPRPNACFLSGSRDISWQL

SEQ ID NO: 3709 - protein, 133 aa, Homo sapiens
PDHPSSNFIDSTAQKHNRSEACSTHPCPRNNGSCPQYHPHSCTCLHGSWAHPCTSAIVSQDWNLSGSKRKQTLYKSRDGDTADCSRQGVGFFTSEILQHRPQRNASLWELWHPKIQPSVEFSGRICESHIYQG

SEQ ID NO: 3710 - protein, 15 aa, Homo sapiens
KNLSSNQLSKHLTKL

SEQ ID NO: 3711 - protein, 59 aa, Homo sapiens
PSDGRQLSLLHPRKGNLQLNPASTPPWPSTSPRGTQISYSTEGDSETPEGTGAAPSGHQ

SEQ ID NO: 3712 - protein, 29 aa, Homo sapiens
AAPTGASTDATVHTTSPLGGRPPATPWTS

SEQ ID NO: 3713 - protein, 75 aa, Homo sapiens
PQPRVEPTDATAQSGPTPTCCPALVTPRSSWSQDPLGIPASHLQAPPPHLQALRTSPSPPRGWIPRVVWEGTWGL

SEQ ID NO: 3714 - protein, 74 aa, Homo sapiens
PQPRVEPTDATAQSGPTPTCCPALVTPRSSWSQDPLGIPASHLQAPPPHLALRTSPSPPRGWIPRVVWEGTWGL

SEQ ID NO: 3715 - protein, 134 aa, Homo sapiens
LGTATATHFWRCFPSIHWAPRSPSFGGRGAATAESSGPDQGAAVGTRGAEPGGPRYQWHSCHRRVYDYHWQHLHLQWTSTGGTTGSWRPPSYPRTSIPHSRRGGPWPSRALYTPPGRWQGLAPSGDRALWCHTL

SEQ ID NO: 3716 - protein, 106 aa, Homo sapiens
WASRRLPPAQANGRPSAAASRECSVLPGPSSVHTASYFLTARLALKPSSKMKLGRVTTTASPARPGTSRIPPPPAPAASPTPGVRTKVWWRQLQALPSPTQPAKIH

SEQ ID NO: 3717 - protein, 94 aa, Homo sapiens
CSCLGPPLPPAWPGGLWCWASSGSWQHRSPRRCLHMRRRTRPAGTRKRNTMSPSTASAAPAARQAPMSQLNVAASGTQFVPHVPRIPTTSTGTT

SEQ ID NO: 3718 - protein, 63 aa, Homo sapiens
RCLHMRRRTRPAGTRKRNTMSPSTASAAPAARQAPMSQLNVAASGTQFVPHVPRIPTTSTGTT

SEQ ID NO: 3719 - protein, 40 aa, Homo sapiens
KKKSKKRSRKKRKKNPRKRLRKKHRQRKSRRKLRRKRRRK

SEQ ID NO: 3720 - protein, 37 aa, Homo sapiens
SKKTSCFKTKSTQEGRVCQERFCCCRKAKGEGENKSH

SEQ ID NO: 3721 - protein, 35 aa, Homo sapiens
LCGIQQTLRRKSSESCFLGTAPSTTSWKGWKSSNI

SEQ ID NO: 3722 - protein, 95 aa, Homo sapiens
RPPRPPLLLIPLLRSLLLSKKILYPMLLLPEICPYMPHSPLKKCKVWKERSSLQNLISLHSPHESPLLYIHLLFQILPLQSKRKQQLATVPLLHQ

SEQ ID NO: 3723 - protein, 40 aa, Homo sapiens
SCARAMGSQWTGGPWALSCMSSWWAASLFLEILRRSSLGR

SEQ ID NO: 3724 - protein, 22 aa, Homo sapiens
VPGGLRPFFWRYSGGALWAGDQ

SEQ ID NO: 3725 - protein, 156 aa, Homo sapiens
PLLVIRGEWARLSHTQPQPFPPISHSRLPGDPRCCAFSGREFITEQLPQLQRAQFPSRLWAHTAQLPPRSGTQAPTPVPLSTAQVSRQHPTVTTGPHPFSPTPNSFTSAVPIAPVWPCSPGLSHKASLVTSPGQATLTAQECGATPFTTTQEGAVG

SEQ ID NO: 3726 - protein, 84 aa, Homo sapiens
GLTGPHAQPAQDPASQPGPPPHPAAGDWPSLPASTFVTTGFGRSPLARKPECRAGRRRRRNLTFRANQGDPCPRPMSLLCLARR

SEQ ID NO: 3727 - protein, 155 aa, Homo sapiens
PIAPRWAGRQLPRAQQRLPPIPPCPRVPQTLARPHPRVGEPPEWQLLKPHSVQAPHLQPRWTPQPGPRPPPGPSRPGISFSKHQQCPPAPAFLAEVPPRHLFYPRTAARSRRGTSSSRPSQRWKRLALRRLAGPPQPLPLFPVLSPKLKHHKQVP

SEQ ID NO: 3728 - protein, 22 aa, Homo sapiens
QRLVLEQKKEEAKELKRRKERI

SEQ ID NO: 3729 - protein, 85 aa, Homo sapiens
RNNPKVTASAATGPSSPSAGSLASKTCMPRSLGPLICSASPRASSVGSPDRKPINSWLIRRASMLWKSGRNVALCPLWLRPPGGP

SEQ ID NO: 3730 - protein, 46 aa, Homo sapiens
NERERRLMREKKKCGKSIWWLKELRVLMFLHLWDSMKQVALHQSNR

SEQ ID NO: 3731 - protein, 32 aa, Homo sapiens
HEAQKNRITEGPCKCTCCCTKRTTRTKEKGGL

SEQ ID NO: 3732 - protein, 74 aa, Homo sapiens
LHHLFLLEDSMNITMPFLTKCSNKEQKIMKLNGKEKYMVEVFQKEEFCLEFVQDFLMGLQVITIFLMLMILEKL

SEQ ID NO: 3733 - protein, 60 aa, Homo sapiens
PLCAGAPKESSWQWENRMELWSSIFLLCRKKKSFLVLRFMSQIILSEFWMCCGLVPTSSP

SEQ ID NO: 3734 - protein, 33 aa, Homo sapiens
CPVNMVPLLLFLMFAHSQMRLNSKNAHLPIISF

SEQ ID NO: 3735 - protein, 64 aa, Homo sapiens
FYCPPGVREAHGAPCDILCNHHLSSTTSSHQHFLNCRFWQSASHQCRILWGHQFWWDISKCWQD

SEQ ID NO: 3736 - protein, 41 aa, Homo sapiens
RAAKNKKRRRIHGQYIHCHAKETWNCWAEAWWCRCPLSYQA

SEQ ID NO: 3737 - protein, 73 aa, Homo sapiens
TCSTQTSLRNPPRRPRAASLPQTCSRSPRPSRAHSLTGRPPRFQSQMPSRSPCCTCTWTGPGCPIYFLCPWRL

SEQ ID NO: 3738 - protein, 44 aa, Homo sapiens
TNLKKQLNQKTELLILKRQLLNLKSQPKHPKNPLLPKSQKQCLE

SEQ ID NO: 3739 - protein, 40 aa, Homo sapiens
DDKRDSNYNRKNYRIQNNSYNHTSNIYHNSRYHTIQNYYS

SEQ ID NO: 3740 - protein, 589 aa, Homo sapiens
HPHLKCWLNLHPKLKLQPKALLSPLPRSPRPPLPRSLHLPHPKSPHLPPSSLHPPPPRSLHPPPPSLHPPLPRSLHPPPPRSLHPPLPRSLHPPPPRSLHPPPPSLHPPLPRSLHPPPPRSLPQLPPRSLHPPLPRSLHPPLPRSLHPPPRSLHPPLPKSLHPLPPRSLPQLPPRSLHPPLPRSLHPPPPRSLHPPLPRSLHPPPPSLHPPLPRSLHPPLPSLHPPLPRSLHPPPPRSLHPPLPRSLHPPPPRSLPQLPPRSLHPPLPRNLHPPPPRSLHPPLPKSLPQLPPRRLHPPPPRSSRPPPPRSSHPPPLRSPHPPPLRSSHPPPLRSPHPPPLRSLLPPLPRQRLPTPLRSLLQLPLRSLLQLPLRSLLQLPLRRLLQLPLKGLLQLPSRNLHPLLPRSLPPRSLHPPPPRSPHPPPLTSPLQLPLRGLLQLPLRSLLQLPLRSLLQLPLRGLLQLPSRNLHPLLPRSLPPRSLHPPPPRGPHPPPLTSLLQLHLRRLLQLPPRSLHPLPPRSLLQLLLRHLLQPLQRSLLQLPPRSLPLSTKALMNQLLSFLQNPHQKLLKTVPRNLVYLQLRLLQRLNLK

SEQ ID NO: 3741 - protein, 105 aa, Homo sapiens
PVSRVTLCLVTFCIIFSVLPHLSTLQNTAVCQVALTSLLLNTFLSRTGANPGTCGIWESSGMFLLQKKCLLPFIFWTPFFSLSSSNSSIVGMENLKCLEMIFYRV

SEQ ID NO: 3742 - protein, 15 aa, Homo sapiens
DDCKKNLIQFPKDSP

SEQ ID NO: 3743 - protein, 79 aa, Homo sapiens
PLTPVKSVDALNPPKLLLVIGLIIIGCIMTAKLYQELKKNGSQVALWKKLTGDTTPGQRIWLFMLVWKSSLSLAEAGRI

SEQ ID NO: 3744 - protein, 142 aa, Homo sapiens
RRPLHPHDPNGMIAPASLKLRFLSSQQWPQLCHKCPPLPNPALVSSLDSWLTSTGHCNESPSLGTAHSPPACPEQNQQPPWMIWHCLHHPLNCCLINRRLVTEAVIYQAMQRCGEDPLLLPPKETRTPSSPETGSHHRTLFS

SEQ ID NO: 3745 - protein, 30 aa, Homo sapiens
SLRSWYPPMELFHHPLPLLHPQPQALPWPS

SEQ ID NO: 3746 - protein, 89 aa, Homo sapiens
IQQWCRAPRAQETLGGQSSQQVYTASRIRVSQQGDPTTSCSTPQAWKTQSFWSQPSWSSPTRVCVSKSPCSEWAWKGLRGGISFSSIRF

SEQ ID NO: 3747 - protein, 105 aa, Homo sapiens
SQNPIAKELKVLHKRRGLAAGRGPHPAGLGTVFAGSALKAGHPVLPTLACLGAREHTGLVLGGSPWAWNLRMVPSRTWWGEQGIGDGREAIKIFGLLWLSLLSSA

SEQ ID NO: 3748 - protein, 65 aa, Homo sapiens
KQPLNPNSPWSCTSPVQRACASKKNASGSTRGSRSGGESLTLRLSETDTSSAFSSLLPLRNLSQL

SEQ ID NO: 3749 - protein, 57 aa, Homo sapiens
PAQTPSKNMTQMVKELSPKKNSRRPWKGKNSTRSQRLTFSCRVQKLMRMTCLITLIL

SEQ ID NO: 3750 - protein, 49 aa, Homo sapiens
STISGSLELFLLTTPFSTLPGIQPCQSWATTITSSLLLTYWTSQWASRH

SEQ ID NO: 3751 - protein, 23 aa, Homo sapiens
RNYLQKRIPEGHGRAKTVHAVRD

SEQ ID NO: 3752 - protein, 87 aa, Homo sapiens
TVRVWKKTPALWSSCSSDAQSASARPCGVRGETGSWQPCRVPLRSLRTQRSTSPLKDTKEKSARGTMKRKKKSCIWAMQLCHFIRPL

SEQ ID NO: 3753 - protein, 32 aa, Homo sapiens
QERDCQKSVQIEAKGKSLDPEQSGDWKQIYEE

SEQ ID NO: 3754 - protein, 213 aa, Homo sapiens
QWMHRMLDIFKGSSQHPSVPRVSSRPPLGPQGYSLHHLAHREFTQQPQSTHKGFSLHLWVLSSLSLKERLQQWCWQMEPQLWPTLLAIHSVLLQQQQPWCRPTARVLAPTLPPRAHRHGQAYSGRNLPQMEWQFGKPSFLLSLLMLLVLEWKALCGVRLGHLGLQVPNPSLKSTCLWPLRSLCPWRLYPIKIMISLPLPSLQLPSSPHRPFQL

SEQ ID NO: 3755 - protein, 212 aa, Homo sapiens
QWMHRMLDIFKGSSQHPSVPRVSSRPPLGPQGYSLHHLAHREFTQQPQSTHKGFSLHLWVLSSLSLKERLQWCWQMEPQLWPTLLAIHSVLLQQQQPWCRPTARVLAPTLPPRAHRHGQAYSGRNLPQMEWQFGKPSFLLSLLMLLVLEWKALCGVRLGHLGLQVPNPSLKSTCLWPLRSLCPWRLYPIKIMISLPLPSLQLPSSPHRPFQL

SEQ ID NO: 3756 - protein, 79 aa, Homo sapiens
FPSPDIGPLPILWPWKPEVTTDRLFPFSSNIFCQLTPLLHTHWRHIPTPQSPVPCPLSDSIQFQLRLQTLPSQLRLVLG

SEQ ID NO: 3757 - protein, 178 aa, Homo sapiens
QWMHRMLDIFKGSSQHPSVPRVSSRPPLGPQGYSLHHLAHREFTQQPQSTHKGFSLHLWVLSSLSLKERLQQWCWQMEPQLWPTLLAIHSVLLQQQQPWCRPTARVLAPTLPPRAHRHGQAYSGRNLPQMVPNPSLKSTCLWPLRSLCPWRLYPIKIMISLPLPSLQLPSSPHRPFQL

SEQ ID NO: 3758 - protein, 177 aa, Homo sapiens
QWMHRMLDIFKGSSQHPSVPRVSSRPPLGPQGYSLHHLAHREFTQQPQSTHKGFSLHLWVLSSLSLKERLQWCWQMEPQLWPTLLAIHSVLLQQQQPWCRPTARVLAPTLPPRAHRHGQAYSGRNLPQMVPNPSLKSTCLWPLRSLCPWRLYPIKIMISLPLPSLQLPSSPHRPFQL

SEQ ID NO: 3759 - protein, 22 aa, Homo sapiens
KELLKVVLQSQKNILRSHFKCP

SEQ ID NO: 3760 - protein, 78 aa, Homo sapiens
FPGRQREGLEIIYLILNIVLLWISQQNRQKNKKMTQQYPLSLKSQVKTIIRIQNCLKKLQLNLQKVILLNYPHLTVRS

SEQ ID NO: 3761 - protein, 273 aa, Homo sapiens
PHGVLAAQQAGQLHQPEPGRGGARGGRGEPAAGGQGSAHGHLHRRLPAVPAEHPGRHPLPAPDVDRGGGWCPGVLPHRGHVLHMYNADRHFHECDRYQRCGPSWRVLLHDIALAGTRVWRRCRPLLLPGHDVCRGHVYFGDHRDFSDVHLPGCGHLPGGGCRWRGGRHAAQHACVRHVHARAHGPGGLRGRQVCQQAGAGLPGLRRAVHPGHLCRRHQVCLRPPGHPGLPPGEPHAVTAQLRCLRQGLRHPQQLSHLRALGPLLQRLPAQRRL

SEQ ID NO: 3762 - protein, 205 aa, Homo sapiens
RTSPRVRPSSRRRLQVARRPPCCTTCVCTARARSCSWPWWSSWASSMSTSWRWSSWPASCCPSWPSMPASSSLPSTPRTSRSASWGTARCHGAASMPASRPTASTTTQPPPRSGASSATAPSPAPPVTSTSSRTTSPKSRASRARPVVSSWRTCGVRTRTRGRLWRRKVCPRCPWQRRAVPAHCPTCSPTSRPPSPCWLASTSLP

SEQ ID NO: 3763 - protein, 378 aa, Homo sapiens
RHRPLPAGVWPREGQRGAHVGAAADSPHLRDWHPHRLSGQRGPDPLHVLPHVLPVREPGLRRADPATYPQLASTLQVLPLDPVLSGYEPVPGADVHLLLVLRAVRHAHRWLHLQVHRVPRGREGVGRWHPWPIPERRPLRPAARGARSPPHQELEAPGAGDAEPGRGAGREAPPPAVLHVAAEGRQGPDHRGLGAGGDVPGQAHGGSAGRGEHTVPNEHREDQGLLPAGGLVQPAGWHVPPDPVGRPGRPEAQHGAHGLARILEAGGQPLLLEELCGHRPRHHRRAPGSAGGQERRLVSAKPGALRRGPHRRVVDRARRRHAHAAALPAAPAQGVEEVPDAYLHRGPGGRQQHPDEEGPADVLVPLAHQRRGGGGGDG

SEQ ID NO: 3764 - protein, 52 aa, Homo sapiens
LEHLCRITCMNCGPYSTFYCLMSLILQMTLILGLTLKIVLVIKNSWKDFMQF

SEQ ID NO: 3765 - protein, 34 aa, Homo sapiens
TIGQTQRTGFKGSHFQPDDSLAGYFGRLLHVAWL

SEQ ID NO: 3766 - protein, 71 aa, Homo sapiens
AIRFQGILISQIQLWLKEKSKKRLMELNLLHQKRLKKRKNFSHKVSQTGLNEILTSLLKLMRNMEEMTLIT

SEQ ID NO: 3767 - protein, 43 aa, Homo sapiens
GGQLLSAERSPEHAARAPLRLRAQAGAPLHAAPWSPLLPLATY

SEQ ID NO: 3768 - protein, 108 aa, Homo sapiens
SATARTSATSSRSASRPSLGPRTCASSVRGAASLCRAIPGARSPCPASTACSSWCTTTCRPLEPPPSPRHLLNPPPRCPSSRLPSHSLGVPPEEPITSTPGARRSPWC

SEQ ID NO: 3769 - protein, 55 aa, Homo sapiens
SECGPWHHHRKAWGGNKAVISIVHCSSEKEEKWTDWSGDANHATSDKFKTSKHEK

SEQ ID NO: 3770 - protein, 52 aa, Homo sapiens
TKHSFWKKLLQAAIETSQKWKEKKHKNPHWLLILRLPKKYLFPLLHLILSYY

SEQ ID NO: 3771 - protein, 33 aa, Homo sapiens
ILTQMTSTLKKSRSALKKMLLHESKGRKDGGNC

SEQ ID NO: 3772 - protein, 28 aa, Homo sapiens
WQYKSLPRSSPINTSSTCRKGRRWYPDH

SEQ ID NO: 3773 - protein, 21 aa, Homo sapiens
RLIHIKKTKSGKKQELTFLLL

SEQ ID NO: 3774 - protein, 63 aa, Homo sapiens
IMITWQKDLLKKCITFGVWLEVTWRKSLSTRKSFDPNHLSAHSPIFSLRMVKALDKVEIEARF

SEQ ID NO: 3775 - protein, 148 aa, Homo sapiens
TAMGGAAAAGRTARKGGVPMSGPGAGSGTSAGTGAVAGAWSGAWTKTMRAPETAAVAGAWSGAWTTTLGHPGTGTVTAAAAGALTRTTSEPITGPTTQTTSGPTARSTGAGPATMPALGDPEAAAASTRTHGAPAPSLGGGRGPSGSS

SEQ ID NO: 3776 - protein, 147 aa, Homo sapiens
VATAASSVTLKTRTVKEAPTLTMSWMSQPRSRWCRPSPAPRSRCSTRRSKLPRSILISMQFQSKRTSQTLARPSTRVPDPLSHRKLLPDLIRIPEEVMAVMPRRRSTASSCQNTPSAVTMASLPDTGTQNYRCLSTDSPRPACMASD

SEQ ID NO: 3777 - protein, 31 aa, Homo sapiens
IQRPTKVLESYLIKPTSLKKRVHTFLQLQST

SEQ ID NO: 3778 - protein, 13 aa, Homo sapiens
FFSTQTPDKVSKP

SEQ ID NO: 3779 - protein, 156 aa, Homo sapiens
SPPLPSLLKRVRRWERAVRSKIMLPNQSWAKSKYLRRWITRPGYRECRSSRKHRMQGSKLPRSILISMQFQSKRTSQTLARPSTRVPDPLSHRKLLPDLIRIPEEVMAVMPRRRSTASSCQNTPSAVTMASLPDTGTQNYRCLSTDSPRPACMASD

SEQ ID NO: 3780 - protein, 49 aa, Homo sapiens
EECLGPGFILLKTPQKATNMFMELEEEQAALHTRTGHAIYVTDKCSSVE

SEQ ID NO: 3781 - protein, 37 aa, Homo sapiens
LKLKKHSLWKSLISNNRSLMKQHCTVLWPLCIPNVNK

SEQ ID NO: 3782 - protein, 117 aa, Homo sapiens
ALLLLVLLLLPRVAMLGVGPQIRRTSHPPGVSLQSPNPNTGEMDKDQIQPGVQEGEIGQIHRLSLDTWGMGKKMDLDGMLTVIGQGLVGMTPRDLGTVAGATAQIQRPIQVQTGGRL

SEQ ID NO: 3783 - protein, 36 aa, Homo sapiens
HHEIWEQWLGQQHKYKGQSRYKLGGDFKTWPPTELG

SEQ ID NO: 3784 - protein, 73 aa, Homo sapiens
QWDRGLGLCSYSGFKLRGEERWVHHEQYKYLFSIWVGQRATCRCASKHRLGRQQQQSAKWPGGLGGLDKLYCC

SEQ ID NO: 3785 - protein, 59 aa, Homo sapiens
GRKAPRILASQVAPRQSRPPTAQTTVTTPCLSAVTPATLQPLPGRIRRKSAWPQEPGGA

SEQ ID NO: 3786 - protein, 131 aa, Homo sapiens
AAQPVSTKEDVNHEAALRRSLTLWGCQRAPSDPNPRCSGLMRPRRPPFSRLLLLPAPFPATALGRGERAPLLQNASGWRAAPSPWFPCWGAAGPPEVPSALSSPVPGRTPQCCPASRRQSSRLLSTAMSCP

SEQ ID NO: 3787 - protein, 43 aa, Homo sapiens
AWGSTTTMLGGSCPSPNVHGERLVWTMPQTCRHSPHQRTSKRR

SEQ ID NO: 3788 - protein, 109 aa, Homo sapiens
AVEAGGSLQCVVLELCGDGVPHRPPGDPEGPEHHPGPGASTCVHSCALQGVSPGHHPDRQSEEALLPEALPREQCDFLCLGPTRQEVDQRWPFLKSLWICGPEAGQCHG

SEQ ID NO: 3789 - protein, 122 aa, Homo sapiens
LQLLLGELRLRQGPDDIREPGCLGPLSVRRVPIPNNDCHLWDQHCGVCVGAQHDQRPPEGLAPPAGLVWTHTGCHVPGSVSHLQPPGERLPGLHLYPVGSGPPHPRDPPARPSGRHLSHHHQ

SEQ ID NO: 3790 - protein, 73 aa, Homo sapiens
VLEFPHLCRPQQKSLIHLTHTEATLGAQGHRLHRAWLRGPGQLPQMLGCTLESHRPRSPWGNPRIQLLLFRRR

SEQ ID NO: 3791 - protein, 69 aa, Homo sapiens
RTTEEEDKSYMHLYTKTMCKGENVATSRQPTPGPGSRSSFLGSWACGARGKKPSPVPHGNSTGEKDQLE

SEQ ID NO: 3792 - protein, 87 aa, Homo sapiens
YLQQALHPEELPQRAHAPPPGREVLRVLHLQKEVLSQDPPGATRGPAQCQQWDPPCRHTPRCPRWPPRRGGLHGGDHLRLLRLPSKV

SEQ ID NO: 3793 - protein, 76 aa, Homo sapiens
QCPSPVCRPLLHSCQRHSPWPHPQATAQPVGKAKKSLMSALSATRLSPPNRTTSSTCSYTQVRSPTNAASVGAPSP

SEQ ID NO: 3794 - protein, 53 aa, Homo sapiens
ERDPLFLSIRSNHVLMAKNAPTATSANTTIRSGPTNPSVRWLMSSASVPNCPQ

SEQ ID NO: 3795 - protein, 29 aa, Homo sapiens
IVQVSPRAAFYRMVNLTWRRNTKLRWSLR

SEQ ID NO: 3796 - protein, 79 aa, Homo sapiens
VFPQSHPPKAMQWVHSTPVRPAAQCQDPPISPTRRPLWSIWPACSILPSWLPTAMGPLLAMLSNTQSLNPWGTMATIQC

SEQ ID NO: 3797 - protein, 68 aa, Homo sapiens
FCPLACDCPKCSHNPTPQKPCSGCTQHPFGQQPSARILPFPPPEGLFGAYGQHAVSSHLGYQQPWDPY

SEQ ID NO: 3798 - protein, 150 aa, Homo sapiens
LLPHFLHKQQRKAPIFRPPRFHSGRWWPLFRLWRRRWSPRLPGYRAWRGARGQPRRSWLTARRWPWSSGTSWRASGPCWGPCCRSMGYCRGGWRTWRTCCATGTSGSCGCPRAARGRPPRCPGHWRMMASVSPSRNGRIWRIGRRSSTET

SEQ ID NO: 3799 - protein, 54 aa, Homo sapiens
KQLILQALGHLLAFQTLLTLSHGPLEFKKINCVLHSLSQVTLLNVVPWSWGHYS

SEQ ID NO: 3800 - protein, 38 aa, Homo sapiens
RTLQSYGKRQKRQKRSNLNWTKWLRSWELTSSINPRSL

SEQ ID NO: 3801 - protein, 107 aa, Homo sapiens
SLTIQWVIFQDQRWLVVGFSHLLQSGACCHQPHLPQLDFHTLLLYLSFTCQGPLSLLQLGYLRTTRDLPFPLPLLMPIGTTWHMQPPDGPCIPPLNRQTTLYLNHTG

SEQ ID NO: 3802 - protein, 20 aa, Homo sapiens
RSLLPWGIWGICLLISALLG

SEQ ID NO: 3803 - protein, 54 aa, Homo sapiens
YPLIFYHSYFDARKLIGISLWIIFLYCKVPCCGFLPYWLCSISYSVHLYCFFHL

SEQ ID NO: 3804 - protein, 21 aa, Homo sapiens
RFLGRMYEKMWTPIIHGIGFQ

SEQ ID NO: 3805 - protein, 66 aa, Homo sapiens
TAFKEKFSIFSQMQAVRKVFLLFWLIKFLRKMFSPFHNLFLSWKKLNMLLPLKNIAFLKQHWNRFL

SEQ ID NO: 3806 - protein, 47 aa, Homo sapiens
QLPGPARHQLCPGHQSEPLRALVLQQGVLPLLQAPPLLGPAAAAPSR

SEQ ID NO: 3807 - protein, 46 aa, Homo sapiens
LGTQCQPGPRTTAQHPIAWRGAPTPRPSGGGSGPSGRRVPAVAGVG

SEQ ID NO: 3808 - protein, 108 aa, Homo sapiens
WASSRTTAPSTARPPQSGWAWTTGCSATRAWTWSWAPARARRPTRCASRPAAGPARGPPGARASETATSRGLLSPGTRMTKRLTPTSPPRSSSRLTPSLTSCWAQALT

SEQ ID NO: 3809 - protein, 42 aa, Homo sapiens
TKEVLLLQEQTKKPPFKGLMASQSAVLSTRKMVLTLGSGVLC

SEQ ID NO: 3810 - protein, 39 aa, Homo sapiens
VPWGTACRGSRWKTLKRTAGSSEKSSSLWTVPSTRASGV

SEQ ID NO: 3811 - protein, 22 aa, Homo sapiens
VKRMPLSTSMLSTFALYQSPGN

SEQ ID NO: 3812 - protein, 28 aa, Homo sapiens
KKSKLQHISVGKFVCSNQPMYLSASQGP

SEQ ID NO: 3813 - protein, 20 aa, Homo sapiens
RLLLKKVKTTTYFSWKICMQ

SEQ ID NO: 3814 - protein, 16 aa, Homo sapiens
KSEGRFHRQRMIARMP

SEQ ID NO: 3815 - protein, 46 aa, Homo sapiens
KDLIHSMKARKKIESPLICFHLQVLLLLNLRILAAQQLRFLVISPY

SEQ ID NO: 3816 - protein, 16 aa, Homo sapiens
KIIHWKLIKQKMLNQC

SEQ ID NO: 3817 - protein, 14 aa, Homo sapiens
RNRYVFFSHQHGRN

SEQ ID NO: 3818 - protein, 30 aa, Homo sapiens
KMYLSGIQCREPDKNLLPKVLWKIHLLQSD

SEQ ID NO: 3819 - protein, 29 aa, Homo sapiens
IFFWRRFFRGWEQLMTVSNKRVQLKHLPV

SEQ ID NO: 3820 - protein, 259 aa, Homo sapiens
PRTCAEHQTGRKGRQEDLADGGGQASRGSKGSRGPLASGQASKALKETRGNLGPLETPARWATQGPAAPSEPVASRELKAPRAAQETSRTSRGQPSPPFGGTPQWGATWSSSTRSSPTRKNRTRTTPADSSALYPATTTSPSRCCPSGKSACPSSPPQGARSDAPWASVTPPTRGSSRWCQGAWCFSCSRVTRSGLKKTPKRVTFTRALRPTASSAASSSSHLPEPGKDPLPHPPLWLPCSACKMGALLLQLLKGGGWL

SEQ ID NO: 3821 - protein, 67 aa, Homo sapiens
EWLTARPGGCGGCLGCGHQCPAGDTACEHSLHQGRGRCGQPMLGLVLSGGQRLCVHQPEQSHRLRGL

SEQ ID NO: 3822 - protein, 62 aa, Homo sapiens
TSLATWTSMPPPASPSMTSPWWSTTRTRAAMAPSCCRWGAPMQKPSASPRSGQWAQPPFRCW

SEQ ID NO: 3823 - protein, 16 aa, Homo sapiens
ILCQKKPRHWISCLKK

SEQ ID NO: 3824 - protein, 13 aa, Homo sapiens
HQVNIIVVPSMKI

SEQ ID NO: 3825 - protein, 51 aa, Homo sapiens
RTGCKKERNTRPLKNCGEASERQKNDAIKSELKGQRGNVCQKGKERCFALK

SEQ ID NO: 3826 - protein, 23 aa, Homo sapiens
KIKQQMPKKFRIWSDKLRKWKGF

SEQ ID NO: 3827 - protein, 110 aa, Homo sapiens
SKKLLEMSVRKYLMELMQVTLMFGYQNQTTQKFLLSGGILMLISHSLLEFLNMDMKNITLFEQTQHYASWKEWENLMRKQLLLNRERMIIWMGMWKIQNTNLPQPSLKMI

SEQ ID NO: 3828 - protein, 31 aa, Homo sapiens
AGGGDGLKVELQRPQQQQLLHLPPVFQAILC

SEQ ID NO: 3829 - protein, 28 aa, Homo sapiens
GVSSLHTSVLIKTDKFSRYNRLSRCLPV

SEQ ID NO: 3830 - protein, 13 aa, Homo sapiens
KKKIRRRYRREAI

SEQ ID NO: 3831 - protein, 110 aa, Homo sapiens
IDWRRKKRKKIEKRKSFRRAEVNTKNISPLLPHLPPPPPLPLLRLQKAVVRVRVTIKKKKYKGRKERKTSVQGITTVILKRRTSLRRESFMKNFLAVTITGKKPRKSPGS

SEQ ID NO: 3832 - protein, 106 aa, Homo sapiens
NTRVLGRTANGAILILTKSPEPINIAQRREALKERRGAAEATAGRKGAGEAGAEVLVVTSKGRQGNGHSEILVKSKAEEMTAEAMAQTCIEEKKCTESTQEVHILK

SEQ ID NO: 3833 - protein, 132 aa, Homo sapiens
LHHLHSQVEMNHTPSSSQNVERKANTFTSPLTFYLEKNKMNMDHQANCLSMSGLTSGGECLMSTMKISLSTVLSQKKSKQQGVPQVSLVEIEFISVKEAAVLVEHAELILQQNCMEKIVNSFLIKYKQKKHP

SEQ ID NO: 3834 - protein, 16 aa, Homo sapiens
SHRKKIFFQKCIYINS

SEQ ID NO: 3835 - protein, 33 aa, Homo sapiens
MPVKLSMTFLIVQQALEYIQLYGSYAWHSYLKS

SEQ ID NO: 3836 - protein, 32 aa, Homo sapiens
GPSIHLVTAVWSFFMWSIIHHGTFLNCFLLFF

SEQ ID NO: 3837 - protein, 29 aa, Homo sapiens
LLFSSQNFMEIIFCCFSGCICFEVHQSIW

SEQ ID NO: 3838 - protein, 69 aa, Homo sapiens
NQLQWISCHNVKRISEISGICPQKRPDNCNRKCQEKTRRYRWQFSGVFCTAHPISSSRKSSAIEASKHS

SEQ ID NO: 3839 - protein, 47 aa, Homo sapiens
PYASINRESYAKKMSQKSQKKKSARTALNSELDVQNAVHENQKERVF

SEQ ID NO: 3840 - protein, 40 aa, Homo sapiens
CRQKRLCCHRRCDSSGDIYFALHHCHSHTHLSTEKVTQRK

SEQ ID NO: 3841 - protein, 125 aa, Homo sapiens
RGRMETRGSKVKKEKKETLMAASLCLGLQACPEIQARLAKKGRQSLGPKDPQVLLVCLGHLALEDLVILGHRGPRGHQDLQLSWEQLWPFQVPLALQDSQGFPDPETWSQHSATWMTCCRKRIWL

SEQ ID NO: 3842 - protein, 38 aa, Homo sapiens
WGKRVNLECMEPQDQWGPKDHQDIKENLAFPGDLVAQD

SEQ ID NO: 3843 - protein, 73 aa, Homo sapiens
KGRREQEGLMAQLVKRVTLATEAYLDPRGKRDKLALLGSWDPQGLLDPLGPQALDAQWDLDSRIPKALEAPSY

SEQ ID NO: 3844 - protein, 127 aa, Homo sapiens
TCGTGCLPSMKCPRPDPSPSSMMPARDWSRLGRCWPTPACTASTARTQSTWMWWSSRQRTWSCTPMPCRSSWRKPCCGAETWPPPCASCGPTASARAWSCSGGSRRGCLPSCSILPRISGLVFRVHQ

SEQ ID NO: 3845 - protein, 127 aa, Homo sapiens
VSGHYLRDFSTNQLGFQEAFLEIQEAWMKWQWERWRLMFRRWYAGRPGSWQKVGPQASRPLCFTPSTCSVPTPASGPSLVSSGRQEPWTCSCTCYAILSLRSAGVQAKCCRLWQPTMLGVGLTSFYH

SEQ ID NO: 3846 - protein, 220 aa, Homo sapiens
IAVQSWELETKAPHVPQERKAGDSGNWSSAWLWATSSLSLCGAWAGPGTSANRACHLPGQPGPSFSPTFQAPAFYSPPLSPPPEDKGGSSASALNSPAVVAMENMCSRHCSQGCECGCWMIMRRSVLGTRASSGRATTAFPLCRFSGSRQAALTGCTGTCWRSWALRKPLRIRLQQLWRRGQGLLCWAQHFPPGTGILWMGCTLCRTSSPNLRRMREWDI

SEQ ID NO: 3847 - protein, 52 aa, Homo sapiens
PWVAPSVLFKGNFVRLWIHLQLLVMWACVRKQMPVLMYLARSSNLIGATVSL

SEQ ID NO: 3848 - protein, 134 aa, Homo sapiens
RETHQPQLAQRHPQHLRRLQPRALVLCAEASLQLTQVTTKTQTEPPAASSLPPSLSSLPSLRPPVLAASGSTRTCTCLCPWMTRTRLVIPCKGGESAQSPEYKSKPIIVVGYFCSSVQQGYWCFQVFILLLLLF

SEQ ID NO: 3849 - protein, 129 aa, Homo sapiens
RETHQPQLAQRHPQHLRRLQPRALVLCAEASLQLTQQTEPPAASSLPPSLSSLPSLRPPVLAASGSTRTCTCLCPWMTRTRLVIPCKGGESAQSPEYKSKPIIVVGYFCSSVQQGYWCFQVFILLLLLF

SEQ ID NO: 3850 - protein, 32 aa, Homo sapiens
KPPSPWLAATVHRPGRTRTLCAPSWLPSSAVG

SEQ ID NO: 3851 - protein, 73 aa, Homo sapiens
RETHQPQLAQRHPQHLRRLQPRALVLCAEASLQLTQVTTKTQTEPPAASSLPPSLSSLPSLRPPVLAASGSTR

SEQ ID NO: 3852 - protein, 62 aa, Homo sapiens
RDLCLTTSTCLRECVTFTPLMDPGRSEAWMNWRKGKAMSVPQTTSLKRWSTPRMSIPTGLST

SEQ ID NO: 3853 - protein, 61 aa, Homo sapiens
TCTCLCPWMTRTRLVIPCKGGESAQSPEYKSKPIIVVGYFCSSVQQGYWCFQVFILLLLLF

SEQ ID NO: 3854 - protein, 33 aa, Homo sapiens
GGAGRGRGQTEEGGRSHAHLGHPARGKVTWAWH

SEQ ID NO: 3855 - protein, 23 aa, Homo sapiens
RMNGRRGFPPPPCDWPPGRRMPP

SEQ ID NO: 3856 - protein, 80 aa, Homo sapiens
NFIHQTLPNYLKISPGTTSACSCEMTSCPEGCPAPLLPWPCWAPTLSSQSSETMTQMNVGAITLVSSALHQTTLKNWKTK

SEQ ID NO: 3857 - protein, 14 aa, Homo sapiens
KNRFEVVLGTFHLM

SEQ ID NO: 3858 - protein, 112 aa, Homo sapiens
WMLSPARAPRPRKQSPGARQPPLTRPTPGAGQRLLRVLQTPGHRLVPSQLPPLTHGGCPLEPPYNLSPRTRTPGQLHSSLPPVLGKELLTRGAQSPPPSPCLSLGPLSSSVI

SEQ ID NO: 3859 - protein, 25 aa, Homo sapiens
QPSDFKKNSRICDLSAIPKQWNYQP

SEQ ID NO: 3860 - protein, 72 aa, Homo sapiens
LLTPQLLSPPTRSLCPRTGPQERPLTAMCPLSGDHLQMFEDGAVQSHYWGFHSWCCRPCASNQDFLLNALDT

SEQ ID NO: 3861 - protein, 160 aa, Homo sapiens
ILFIVLDLLGFPMQMPKELVIQLVFPWAMQQQLLPILLTCILERILPSKQVTLLAHLTKCPVPPPAGLCHRTPPPRTPTRLPCTLCEVPTPSRARMHSKARTTHSRCMQHLLTSSTTPRWCSPTACLQRCTLLPSPLLEATGSPWAWWLGPPWPCQQVPC

SEQ ID NO: 3862 - protein, 30 aa, Homo sapiens
NQGKERPLLCQESLKRKKMQNLWNVLMQIH

SEQ ID NO: 3863 - protein, 24 aa, Homo sapiens
WSWRISSRIFGGKKIVALMSSTII

SEQ ID NO: 3864 - protein, 148 aa, Homo sapiens
VEPTASVLDLNIMDKCKSSQNRGAQWGLTPQDWHPASMPTPVRGPHIHSLSFPITPSPLLPNISSQAPIPSHPLIIFLQNPGLAWTLIPPPIPQGSSRLSLCVIMFNLNRSYCGRVGAGKMPPPRNLPTRVPSFWGVPRLAQAVLKLQ

SEQ ID NO: 3865 - protein, 99 aa, Homo sapiens
GPGVSNCPACPTPVPLCPAAWAPQSLLNAAAAAPAASALPILSAAAPPWPLLSPLAPHQRMEHPPCLALCLPSTTCFGQDMLQPEGVVLRPLQHPAWIG

SEQ ID NO: 3866 - protein, 35 aa, Homo sapiens
REIWGALPSGPGLALHRRTAMRAACNLKPAGRRAS

SEQ ID NO: 3867 - protein, 182 aa, Homo sapiens
RGWGHRRCPHPLRAILRGASPSPHSPASRPTHPSRALHPRLCPAHKVTRAVSTPSRVASPMATATGWLNQQPVGTDWSGRPTVSTPCGPMATTASARPCLPQAMRPWLRPHAPQRCHSSHLKMWCPAAPRTVASSPMEPLTTAWATSPPSTQTPEGAPTCACPSSTADATSPTCCRSHPPCT

SEQ ID NO: 3868 - protein, 25 aa, Homo sapiens
LCPGGGAFWKPPSQGISSCLMTGCW

SEQ ID NO: 3869 - protein, 184 aa, Homo sapiens
QRYVRRVPSLHTLSCRHPALTPPIPPLTPSSSHGVGGLGVHSGPAHLSPFPFIQTLRLAISTAHSSTLPLRPVGRGQVSAGLACGKALELGTGPPDEVAVCSHTHTHTHTHTHTGSRPRIEAAQKLLPGFFSSELVLSQTPSSQGTRISNESWKPSHSFPQSEEAVVMSPSPTGFPTRRGLGPR

SEQ ID NO: 3870 - protein, 80 aa, Homo sapiens
LSGTALQRNVICSSRRGPVWEEPPLKSSQPATSLSPACRIPRRPRTWCWAPVVCCKGSALGSATWTCQQWTLTPSLSWPR

SEQ ID NO: 3871 - protein, 74 aa, Homo sapiens
LSGTALQRKRGPVWEEPPLKSSQPATSLSPACRIPRRPRTWCWAPVVCCKGSALGSATWTCQQWTLTPSLSWPR

SEQ ID NO: 3872 - protein, 31 aa, Homo sapiens
LYPCVFSSYGKNINPTKARNRIQESSNIFRP

SEQ ID NO: 3873 - protein, 25 aa, Homo sapiens
KMGDLSTPAPPTPFLPKTIPFILLQ

SEQ ID NO: 3874 - protein, 75 aa, Homo sapiens
NSFHSYHHFRRTGEACTERKIIVTFSKYNWNITIFDYIHVSSLPMEKISTLQSYKTETRRQARNRIQESSNIFRP

SEQ ID NO: 3875 - protein, 59 aa, Homo sapiens
GCPRTPASWSWPSACAMPSTTAAQSTWTTTCSRETWTTPRAPTLTTDRAGALTLPSLPQ

SEQ ID NO: 3876 - protein, 54 aa, Homo sapiens
ETTCSRTPSRGFFSFSSQSCIFKSNSIKNGFPKVDRSASKYSISEMFFRYPSGW

SEQ ID NO: 3877 - protein, 54 aa, Homo sapiens
RIYCPKLVYYIWPLSEKGSKKTVKKKKKKLTPVEKLRRKISELLLGNNMQPNSI

SEQ ID NO: 3878 - protein, 52 aa, Homo sapiens
QFGDKNSQNTTMQIQSMVLFRYYLLQPVGMEVFLKKKLMNILKRVPKSLGLT

SEQ ID NO: 3879 - protein, 62 aa, Homo sapiens
WPVLHLGKEQPWAAWLREGVPLPSQPTEGEVPGGDPTGSGGCRRGSQLCPVSLRSCFWLGDE

SEQ ID NO: 3880 - protein, 58 aa, Homo sapiens
VWGKKRRERSKEEKVPEWEPPEAPEKERQEDDVPAGAAEWGRDAVRWLLPSAVLLPAE

SEQ ID NO: 3881 - protein, 51 aa, Homo sapiens
FHRLSATAGCGHRHVQRALFHTKEQPTLQQHQPAPRSVCSWAPRSRQMCCG

SEQ ID NO: 3882 - protein, 71 aa, Homo sapiens
LQSAPGSVETATAPPRESAAAVQAGRGTSAELQNVSQHVVMEVSVLDRTSASVKKDILVLNVNKWTETSAE

SEQ ID NO: 3883 - protein, 150 aa, Homo sapiens
KFRSPEPWSSRRPPHPHPHPHPCSLVPVPSPLPLPHHPPCPVWGLRPSQQHPRPHPCQAWGPWPPQHLLYHHPCQAPVSSCPHHLHHSRAWDARPHPHPCCLVWAGALLHPHLHYCPAPAAPPWREAWRRSSWPRWTMAWAQHGSPAIGG

SEQ ID NO: 3884 - protein, 52 aa, Homo sapiens
RDQRRHLGPRGPARAHPAAERVYRAAAAGRPGSPARPGGCRPADPAGGFRGG

SEQ ID NO: 3885 - protein, 51 aa, Homo sapiens
AAPTPRLWSPTSPASSDYSPSLQPSPRSPPWWPPGPGRSPRRSLSSMPRRA

SEQ ID NO: 3886 - protein, 110 aa, Homo sapiens
RDQRRHLGPRGPARAHPAAERVYRAAAAGRPGSPAVSPHCSGPAGSPSCSQGQAHLPFGSQPPHLSSTSRWQGGGSLGVTPGVQPEARSQARIQLTVPGSCPQKLGLQQP

SEQ ID NO: 3887 - protein, 69 aa, Homo sapiens
AQLYVGVPEQPRRRGCGARLLQHRATILLPCSQAQGAHHGGPPGQEGAQGDHFPRCQEEPEPQHLPEAI

SEQ ID NO: 3888 - protein, 32 aa, Homo sapiens
WRRTWWGPRLMTPTTGAPPPAGWPQAAPRPSA

SEQ ID NO: 3889 - protein, 172 aa, Homo sapiens
PPRGLAPLPHPRCCPSAPSPPSPWTRFLRFPSSWRVRSCPRGPQSFPKKAPHDASPYRASWGPSPPSPCTDTARTRAVSGAAQCGHVAHPGIKALLGRSPWRPCSGGPDRGRGEELESTAPPPALGTIFSCSPLGPSERGRGRAGSRWGLWSPHCPEGISWSNCPEAPGPGP

SEQ ID NO: 3890 - protein, 47 aa, Homo sapiens
KISQLKGWRTHQNVFLASQAHSATNQVHSTARCVPETPILRKEPKNV

SEQ ID NO: 3891 - protein, 78 aa, Homo sapiens
SPKSAGRISQMLLDCPLLERRRIVRLATLDFITMDHLLAIPVLLEHFQMEPKNVDHVQQERSLHLALNINGGMSFLAT

SEQ ID NO: 3892 - protein, 108 aa, Homo sapiens
ASGLERGPGVARETQTCLSGCQHQADAVTALPGLRESWREPEDGAVAPEADHAAHPPAAADHPGPFVPELKDGPVPFHQQGPGVSQRPLPHHGQRLRGLRALPPHGAL

SEQ ID NO: 3893 - protein, 201 aa, Homo sapiens
EGSPPGLAGAAAASDRCEPGPEAHGAGSGTRAACWGWLSPRPPPVKAASPPASRRTLRCHSLSSPPAASAPRPPAVPGSREPECSSGGRAECSGGCQEPEGWAGPSLLAHHPSPTSCSRSGSPLQPGPSSPTTPRTPWRPQATTCFPAQSGLHCGPWLRPGSHGTARGTVHGRHCGPRRGERPFPSPAGSPSPRWAAVSLQ

SEQ ID NO: 3894 - protein, 64 aa, Homo sapiens
ARTRGTWCWFGDSCCLLGVAQPQAPSSQSSQSPCLPPHPQVPLSQQPPSSLCPPSPRSTRFPGT

SEQ ID NO: 3895 - protein, 31 aa, Homo sapiens
HGCAHRAPDSGSGGSPPGCILPFLACDWLGC

SEQ ID NO: 3896 - protein, 97 aa, Homo sapiens
GLPQPQEEEPGPVRCQAEAAAFGQSRSSAGIIYMGSARRGRTVAIRTTFLVGRWPLRVAFRRLGPLQVEALARLRTSSPRLRKWRKPPRLHPPFPCL

SEQ ID NO: 3897 - protein, 17 aa, Homo sapiens
VAPHMGVLVLPQTSRIS

SEQ ID NO: 3898 - protein, 74 aa, Homo sapiens
AIRIPRVLWAFIATKIQWRVQCVSQIAEITSVTKKVRRAVLRGQRIKGVLWKAKVIKNYCSYLPVLLMTGVIPP

SEQ ID NO: 3899 - protein, 128 aa, Homo sapiens
AHEGWPGGLSAAHPHPCLGCFSAQAGGLQVPAWLPSLHALSGAGLQQVGGEPEPEPETQPPPGPEEGGAQDQTLQERQETHDQGTAAPVASRAPLAGEGCGRCSVDERNHRRMTAPGSPNLFPSATSH

SEQ ID NO: 3900 - protein, 99 aa, Homo sapiens
TSRTWRSCRWRGRTSSGSGTTSTAWPSCWTTQTRLSPRRLAGGPLSRPPPPLPRMLFSASWRAAGSCMATIASCTQWGGSSASGGRARTGAGDTAPTRP

SEQ ID NO: 3901 - protein, 40 aa, Homo sapiens
PAVPKASRPQPSSGREMGSLSLLPDTSCSLMAPWSLAEWL

SEQ ID NO: 3902 - protein, 245 aa, Homo sapiens
RMFVGNTTSMGTGPSRRPGPCQQPAPSCITSGVLRGTWPLSDSMPGAPPRSPWSSSSSARSPTPVCTMSTTCPCAAPAPASAGATAHGVTAARSVAEVTSPAWCSAPSTMRPTPTTCASASHGQLTGVPAIFTLARRPSAGRQGHGHPAQPPVEEAPSPAPCTASRLTGPASRRPWRRLSVPGCLGSPLPFRPVTCSAVQPGARSPGESVLSVVALASGSGALLAGVKGVLCSIPQRAPWKTGHL

SEQ ID NO: 3903 - protein, 329 aa, Homo sapiens
LSPVCMRTAPSSVTRPGMLAPGVYAPRAAARALGGDRSSVPLGRPATAGACSTPSLWMWSLVTRSPVISPRRSPACRMCTPLPATPGCRWALRSPLPQTPEASGGQPRNTPQPGVTTGENEVTPGATKAPTCQPWAPLPLCSSPHTSNPCGRAQGPTTADTVLTGAAPMATRHLSGLSGKAALGPPVSRAGTGAALTGYLSLRGPITLAAQSRMVVTAPGACPGQGQWLLQSTTPTSPRPSRMSPVSAGAPSLAVAMTTWPLQPVLLGKAVWASPAMPTPCGACCPVPMALAQTGLPAGTSLPLWANVTASGMAAAMAMPITLPRSKSA

SEQ ID NO: 3904 - protein, 161 aa, Homo sapiens
AAARDLSMGPVVPSLGLLEGAPTRMVAAAVLQASRNPASTGQGPRCRESPGLLVVSGGKTNSLGQGRPPTPRPLENGHGGRSLGPGPLDWVEMPDHQRHPSTAPPTGLAWQVWSPRWCRQPWGSWCGSPAQTTLPRNPRLPGRKMASPSPLTGTGCSSTDP

SEQ ID NO: 3905 - protein, 43 aa, Homo sapiens
PRWWRWTVTRARTPGCRTSCSRPRSPGYSACGRTMARCAPPGC

SEQ ID NO: 3906 - protein, 108 aa, Homo sapiens
ASATRPSTGWWCWSRTMASLRARPPPRCTCSWWTASPSPTCLSRRRPRPRPRPTRSLSTWWWRWPQCRRSSSSRCSCSWRCGCAGGAGRPRSVAARCLRAPFQDIWWT

SEQ ID NO: 3907 - protein, 106 aa, Homo sapiens
WTQVRRGTATVGGMAILQVTAGHPLAMAQGPAGHPPTMVQGPAGHPLAMAQGPAGHPPTMVQGPAGLPLAMAQVTHPLVHITEEVEENRTQDGKPERIAQLTWNEA

SEQ ID NO: 3908 - protein, 34 aa, Homo sapiens
RSRSPFLSRWLAVFPAPISRLQSGLCISGTMSIS

SEQ ID NO: 3909 - protein, 76 aa, Homo sapiens
WRRSCPLQAPPLAPPPPGCRLCPHPTRWTASPAVPSAEPGPAAPTAPLSSAIRATSKSSHRCPCSKMCRLPSCTSC

SEQ ID NO: 3910 - protein, 75 aa, Homo sapiens
PLLPRAVACAPTRQGGRLLPPFPPQSPAPPLPQLLSVPLSEQPARAHTAAPAQRCAGFRAARAAEPEAGPVWGDV

SEQ ID NO: 3911 - protein, 39 aa, Homo sapiens
LWSSSMTIGSMKRAELSCSVPCFTPAVQGSVGSASIIWP

SEQ ID NO: 3912 - protein, 224 aa, Homo sapiens
TSTSQFHLCHHLGSPSPSTQGIISPAMVGNQGPQPPPFPMEPTMAQYQAISKHLPKVCQEPHLPRGHLQPQQHRLLVARLHMASLAKEMYRMGQAPLFRCKGCLGLSHLGPHWPLWATSHLCFSPMALPRQVHRWLRSCLECRSAVLWPQPLLLQGWALAHQHRWLQPQEVSLTLVCMAPILRARLLPLARPKVILGSRLPSDLPHHRPPASHPQLQGVLGCLR

SEQ ID NO: 3913 - protein, 19 aa, Homo sapiens
CSPPVFSAPGSYRQTCGCL

SEQ ID NO: 3914 - protein, 28 aa, Homo sapiens
KNRRKAERTGRNRTQIQQCERERRTRNC

SEQ ID NO: 3915 - protein, 81 aa, Homo sapiens
LWAEMDLEKVTFFMQFSLFSVMSLVIFVQNSGWLYCMKVLVLVLFLLLWRLFLIIQTTGYQSIKRKFHFEELLVPKRISIS

SEQ ID NO: 3916 - protein, 46 aa, Homo sapiens
TVGKTKKNILVKRESKGLSKSRKFSQSRDRTVSASHRKGQRRTWQN

SEQ ID NO: 3917 - protein, 36 aa, Homo sapiens
CSPKSHPKIVEKLLLLMVIKFLQDVIIHLKIQDLSS

SEQ ID NO: 3918 - protein, 21 aa, Homo sapiens
KKVLTNLWNLNGWKDKKKYLG

SEQ ID NO: 3919 - protein, 279 aa, Homo sapiens
VGLGTWPPLKALQRPARGVFGQRGYQPQPIGLSRSPQATRHTAACPLAPCPPSAATPVASCMLPTVQPCPPAVQATRCVCCLATPSGACGYSVHRWTLCSTTAPGPGPRPAGPQVKGSWETAPVVLLFAGEGSGPLVALSLGESWAQQGVGESRPTLAGGGTLCIWKAPRAAGLSRPAGAFPHFPTLGTQTHAHMCWVEGSSLFQPVPEPVPEKDPVPQGPWLLACSLQYGVRGSGLGGPPRVPGILHTSVLKGLLVTPSSPHPKLCWSQSAGLCRVHG

SEQ ID NO: 3920 - protein, 176 aa, Homo sapiens
PPCPPPASWCRWPWAASPSGWSVRSWVRCWPSWAPVCCQLRSCCRHGVPAGTWPPVWPGCSSGWPRMRSRHPCPPEAPLLLTGPHWTYTGTCRKTRGRRTPACMGSRHQALTRPRRSWPTGHHSGSRVPNCGALGAGPGSPQLRSCRRPAAHHMGPWRRGWNLNLPPSPSSLCAVS

SEQ ID NO: 3921 - protein, 47 aa, Homo sapiens
GCAARGAGGTHFRAHSQLRVRRGARPRRDCQKEQDPVQGRTESGCVS

SEQ ID NO: 3922 - protein, 109 aa, Homo sapiens
RAQNASSSLAPRSQRAHCCSAPPAVGRRCWPRRWPRRLRCPSWRWPAQSSWRSLEASALPVCGASLRKPEPGPPASSTSMRSTRWARSAPPPCPASPTRRRSRRSTSFW

SEQ ID NO: 3923 - protein, 78 aa, Homo sapiens
HQDSVGLTSPTSAMRLRCTRRGRDTLPCTLSTSSTPWSASSQGLPKRARSCPRKNRKWLRFMSRATPWWAGCWSTRRP

SEQ ID NO: 3924 - protein, 35 aa, Homo sapiens
IQSHSQIIELITTFGACTIRGIIAQCLRSFMFSSL

SEQ ID NO: 3925 - protein, 20 aa, Homo sapiens
EIMNFLGKERLDKLLDTMLQ

SEQ ID NO: 3926 - protein, 16 aa, Homo sapiens
QKTLQEARCDHRLTGA

SEQ ID NO: 3927 - protein, 57 aa, Homo sapiens
DSKVMISPSFSIFERTVLFQVHFGKMKAVIPISPLTHQEAKRCSHQETRRCLLTKKA

SEQ ID NO: 3928 - protein, 32 aa, Homo sapiens
MTLSCRSEMNPIMRRTQKKRGLIFLTTIFISV

SEQ ID NO: 3929 - protein, 18 aa, Homo sapiens
KRSGLKSMEKTQIKLVTA

SEQ ID NO: 3930 - protein, 246 aa, Homo sapiens
GTMAACLLAWRPETPWRPGSWGLVRQVGQRPRVKITPRLPWSHTLQTLEWRQEKPSASEQALAGARPAPHPPAPRACWRRCWQPAAPRRWLGGSQRPRALGACWRRKEPGQVLPKRRCWSLAGTLHPPGGRSLMVRPARQKTWMAPGALQQPGGAIRGQHRLLGDPPKALLPDPPVRTSPSLRTPRSSTVPCIGAVPTWGASVGTGPRSFGLGVPWACRRQQTRMHTCSRTLQSHGHLGCHLQMKR

SEQ ID NO: 3931 - protein, 116 aa, Homo sapiens
RTHSPQVPALRDSLAGPRKICRVNLGSQETHSPAVSVLPAGVKVLLRTMALGVQALEETQVSERGTGPASMGKEQGKGAPGSGPAGVASARRRWRPAAAKTRVKCLPQGCSQPRTG

SEQ ID NO: 3932 - protein, 107 aa, Homo sapiens
SLQQSAGKSTARPLRRGAFLPTWPSTGTWLRQPARSYLLIFPSPGFPQVQPPPQRMEALPAQASPQKPQAQALALPIFTRLIRVLPATHSFWKPRLLKLPRLLPAPL

SEQ ID NO: 3933 - protein, 99 aa, Homo sapiens
RLLLVFLGATPCRPWNGDRRSPQLRSKPWQVPGPPPTLRLPGPAGGDAGSQQLQGGGSEGVSGLGPWGPVGGGRSRGRCCPRGGAGAWQGLSTLLEAAA

SEQ ID NO: 3934 - protein, 146 aa, Homo sapiens
PLLPAGSLSGPARAGWAPSTVPTHSPAGPISITGMVLGCRELTVETFTALHSGGPRIIPQACGVPQAAATPEELAAHLPLTLFFLLTTWVGVESPCNSVDADSPTGTSDARERSTKWGSPPAARGRLWEQLFSAHFPLCFPQNISV

SEQ ID NO: 3935 - protein, 111 aa, Homo sapiens
GGEIPKAQTARGGGKMILLLQEWSRAISGGIAKRRRLHGMTRKRINRDGVMDKNQAKGGLFLPVITGEKLQGITIGVRPIRNPAQEVVTVTGPFPVGTNLVKLVLSLGETT

SEQ ID NO: 3936 - protein, 89 aa, Homo sapiens
VSPQTRGRSRSTSVSPPMTLAHMRVGVLWQVLMTQGGQLPLPMPPPTLLDRSFPWTCRATRSWSSRRRLHPHPHRLLANHQGTKQNTGQ

SEQ ID NO: 3937 - protein, 17 aa, Homo sapiens
GVAPGFQWGEGLRLPSA

SEQ ID NO: 3938 - protein, 179 aa, Homo sapiens
RRTQVSSPTSAESAPRSSCGETASCATEDTVSAGTAWAGSGPYLGLGLPRGHPCRPRESLPEWAGAAATKRVRPRPRPADVSGPHPESTRWRWASVEVEEQTEGAGYWGGVAFGKGNKEHDARALWPPGDLPPHLLSSFISVDLYIFWKGNHSFTIARPFYYSTPPPQGISRTKPFLSL

SEQ ID NO: 3939 - protein, 29 aa, Homo sapiens
GKKLFHSDPWYSCQHWCSFVTELKPPWSP

SEQ ID NO: 3940 - protein, 89 aa, Homo sapiens
DIRGFMVIKMFRILSTGSPGKVRVGRKASGKILRLPCLINVMSVREVSHGIEVLLNIRKSTLVRNPISVTHVEKVSLELHTLFNIREAM

SEQ ID NO: 3941 - protein, 51 aa, Homo sapiens
TVSNQRTPNSWLKKGLRKLFFPLSLRAKTHHITKALRVTILQVMHSPALGL

SEQ ID NO: 3942 - protein, 110 aa, Homo sapiens
VHSLTAHDMIGHPQGSVTPRPVTWKCAMAGVEANACVPTVIHLSMRQPQPLTAKGPVTAAKPGQEPIAKAVGAARILQSTAHLPAALLRMSRPALPQLISGKTNPFQTWS

SEQ ID NO: 3943 - protein, 86 aa, Homo sapiens
RKSSLKRWSPLFPHQQCCQYTFWCQWSTMTSHLLVSRSWFVPDQLGSTHVMWLWPQSLSAWAPVNLELASTLKASCGRKQKMGCWW

SEQ ID NO: 3944 - protein, 148 aa, Homo sapiens
GGMLPAGVNVVPSVAWVTAHWTSTVPNIAGWMGRLRRLMMVFAAAIPNQATVKNAQGNVTRVAGAILPGLNVQKAVTVGPRGEGLFVSIPEMMYWMTANAHIKRKLPFRGAVSSLVHSGNLETGQSAWSPVEKGISTARSGVSLVKID

SEQ ID NO: 3945 - protein, 31 aa, Homo sapiens
DTSAAEMRMALWLTRVPVLPCLDQWQRKNVL

SEQ ID NO: 3946 - protein, 65 aa, Homo sapiens
PERPSATHTPDRSRNATAKAHGVPSTLGGQRNGKNAPRPAAKAPGTARWCVWMTTKTRCMGHAVT

SEQ ID NO: 3947 - protein, 49 aa, Homo sapiens
QSSVFSETTSLEGYKWQGRFYFKYSHRNKGWTKIWDSVFSETTGLEGYK

SEQ ID NO: 3948 - protein, 27 aa, Homo sapiens
RMDKYVGQCLLRNNRPRRLYLKRKFLF

SEQ ID NO: 3949 - protein, 27 aa, Homo sapiens
RRDNNLGQCLLRNNRPGRLYLKRKFLF

SEQ ID NO: 3950 - protein, 20 aa, Homo sapiens
PEEKRMEKYLGKCLLRNHQP

SEQ ID NO: 3951 - protein, 20 aa, Homo sapiens
PEKKRMEKYLGKCLLRNHQP

SEQ ID NO: 3952 - protein, 67 aa, Homo sapiens
QERFCFEYTHRNKGWTTIWNSVFSETTGLEGYKCQERFCFEYSHRNKGWTNTWDSVSSETIGPEGYI

SEQ ID NO: 3953 - protein, 148 aa, Homo sapiens
ATLAIPRPQVATHQLHQVVVPGEVLPTLLRPACPPSGWITWPPMRGSSTRTISREWRPTCLGHLEEPTCPTCTLGPLGLATHQCPLAALGSPPLPSSLFLPMGCIHPQEETHPPGCPHIRHTQGPLCRASPCHPPDSSPQGPTLGSHQ

SEQ ID NO: 3954 - protein, 116 aa, Homo sapiens
CPPSGWITWPPMRGSSTRTISREWRPTCLGHLEEPTCPTCTLGPLGLATHQCPLAALGSPPLPSSLFLPMGCIHPQEETHPPGCPHIRHTQGPLCRASPCHPPDSSPQGPTLGSHQ

SEQ ID NO: 3955 - protein, 81 aa, Homo sapiens
TEPTKQNSKRPWKRPFEATHQGTSSGSSSLSLRETVMKAQTWTCHSPREMPRSCMRPGRTAWEQTSPSSMRFCAPGAGPTW

SEQ ID NO: 3956 - protein, 147 aa, Homo sapiens
RQQRVNRSLRQKHWVAQTLNQAHHELGGQPSGLGAAAVQNAVLVSTSQTPTMSTSRYTSPLSSVCPRTSSLTFPWPGSPVALSALLYSTGQALPLALALALALALAPQMKSWKQVQPQVPWQTQAQTTWLLPWRTRCPRRCRTPSPS

SEQ ID NO: 3957 - protein, 100 aa, Homo sapiens
RPQASMGQRPSWRCGYNPSSWSSSSHTWTSSLGVLPSLVVRWRVGGDRFQGPGHQAAPRTLCPGHCLITCLAYCRLAMDPHRCGPTILSSRLQSTRGRGL

SEQ ID NO: 3958 - protein, 78 aa, Homo sapiens
LPLWFRSNRSALCLWCPPSHSLPRCPVQCVARFMWHLQIHARGLAGLMGLLEKGLGGPELLDPLGGMGVVFPLMLLWP

SEQ ID NO: 3959 - protein, 41 aa, Homo sapiens
QPWQLPRTHTTKKWKRFVVVTNHFWPQMTCRPNTCNLRKNL

SEQ ID NO: 3960 - protein, 116 aa, Homo sapiens
IKKMALQTLSRTVKQVQHLKISGLERKPQYRVKCKRGMMNLKVILNQIPLLLRAVKRKSKMMKKFFRGNKEILMMMILNQKIWVIGLSSWILKMRKKRRNIALILIMSRLKQSTVT

SEQ ID NO: 3961 - protein, 105 aa, Homo sapiens
DLEMALKFYWVRDLLSSRHSSIEYSSNYSREIGDYSNSIYSIVILTSSSSSSSSNSNSSSSNSNSSSSSSSSSTTTTTTTTYFKMLICSSINMQHSSNRCFNNNF

SEQ ID NO: 3962 - protein, 32 aa, Homo sapiens
WTLLEKKTRIKASAALTSARKKKENYFRSHLN

SEQ ID NO: 3963 - protein, 98 aa, Homo sapiens
IFYRLTVWLQLSVRTPIWNRKRKVLRDKKQLAKSSEPRRPLGRMPRGRPRRGAGHHRERPPLQRGMRARSRSISVPARLLPSSRTALPACSHHLKPPW

SEQ ID NO: 3964 - protein, 98 aa, Homo sapiens
ATSPRALSRWSASGWASLQPASPPHPPPCAQASPGHRSLLPKNPRTLLPTASFLGWASAQTAQQVTGIVWAVRAAWAASAVPAAGRALRALMAMALAS

SEQ ID NO: 3965 - protein, 160 aa, Homo sapiens
PSNSARSPLAPRPERHPCPPASISTSRNQTLLSGGPSAGRESHCRPHCWPSEWPVPRLAPLPHCLPQLLASLLQLLAFPSPSPAAFQPKEFQPPLLPAPPCSLQCRPAQGQVWKAQQLVGGMGRQNPRPPLLPSSRCPEQEQPPSLCRWPAPSWHFLALS

SEQ ID NO: 3966 - protein, 58 aa, Homo sapiens
GLEPILQGEQRWRLSCSEKHNCSGQNSVRPCTDPPCGRYGRTRDCRGERHPGLLAGSR

SEQ ID NO: 3967 - protein, 58 aa, Homo sapiens
GLEPILQGEQRWRLSCSEKHNCSGQNSVRPCTDPPCGRYGRTRDCRGERHPGLLAGYI

SEQ ID NO: 3968 - protein, 35 aa, Homo sapiens
LSGGKTSRAPCRIYLNLQELLLSQDKRGPLWYLPF

SEQ ID NO: 3969 - protein, 89 aa, Homo sapiens
RSSGTGHFFSVTATALLCAGQCASSQRPCWSLGRTPSCPPRSRDSMSACWAVQPSTAPPGPWQSWPSWPGSWAADIKVPYRRTSSHPQT

SEQ ID NO: 3970 - protein, 164 aa, Homo sapiens
ELRDDRAPRQSPDAPPGPATSSQSQPQPYFVPGSVPALRGPAGAWGGRQAALHAHGTLCRPAGPCSPRQPPRGPGRAGQAGLGAGPQTSKYPTGGPVPIRRREDLGDGQRLSPTPTAGRRVRAGLPQLPPAMLPGGPVAGSEWRNQGQGAPAVPSIDPKEEEAL

SEQ ID NO: 3971 - protein, 147 aa, Homo sapiens
DSRTPRDRAFPLQARRGQHADRARQTQQLPLSIFSTPCISKGPTAGRCNWYRLAQGGPREAHWPGLESHPPEDRPSICPAQRPPGARLSQDLITAPPGPQQPLHPLCSATAFQKPLLGQRAAPWGAGGQEEHQGSEEPRRARRRTSK

SEQ ID NO: 3972 - protein, 140 aa, Homo sapiens
PGRTLRELRAAPSCLVSSPCTQWIQAVPSSGHPGAPARALSRQRPQLSRTAPSVAHHSLAPLSGPSTPGWRIFLTLQWALIGSQKKPLERPVRFPYPKGQSFPPPGQEGAACRQSPPDPATSSQHLLHSLHQQRANSRQM

SEQ ID NO: 3973 - protein, 102 aa, Homo sapiens
GPLARTGITPPRRQTIHLPCSETPRSQALPGSHHCAPRASATPPPSLLSHSFPEATPRAACCPLGSWRAGGAPGIGGAPQSQKEDQQVKGQPGPCPVLTPFL

SEQ ID NO: 3974 - protein, 27 aa, Homo sapiens
KSGTKMAGSFRGAELLREAGLPPGPPG

SEQ ID NO: 3975 - protein, 81 aa, Homo sapiens
PLHGSSAARLAWSRPRGPPSLLCKPGPPSSPTQVSYWGCTYSLWLACLSAVTPWSCLIDARSLITVLPPRLDLILRITLLK

SEQ ID NO: 3976 - protein, 70 aa, Homo sapiens
VLLSGALVTVLLVGSMPTSAASWPCAWATGILMPLLSLSPSLSPSPVATSCSPTSTDSSARPRSTEDHLK

SEQ ID NO: 3977 - protein, 23 aa, Homo sapiens
ETPGVGPPSTTQQRTGRWSAARP

SEQ ID NO: 3978 - protein, 70 aa, Homo sapiens
YRGMRSHPPGPCRTPAGRPRPAPLGARPSARSRSGGCLCGRCGATSSRPLAHSVASTLAPASRGPSTGSA

SEQ ID NO: 3979 - protein, 117 aa, Homo sapiens
CNKLQPMPRTHSQDSRTAFPHMASRLKVDCHSLSHLDRQDFSAMAQASVPLNLDRHHTATRCKVAVLQHHQEYIQEIIHSQIPLDLIVHSRTIRLIPVLARVSTHSIITAHRIQHII

SEQ ID NO: 3980 - protein, 79 aa, Homo sapiens
KKNKEQKSTRCPSGGSPATRTSWPCTMPWNWSTCNSARHFDSAQLLCDQGQIQQAPVSHQRRPPELSNFRLVMRSCCQS

SEQ ID NO: 3981 - protein, 178 aa, Homo sapiens
TISQVQQLGAVVSAHDQLTSSLHHRFTLPTDHTHIFSLPLPHKLWLHMGKHSLPQECNKLQPMPRTHSQDSRTAFPHMVHCGQASRLKVDCHSLSHLDRQDFSAMAQASVPLNLDRHHTATRCKVAVLQHHQEYIQEIIHSQIPLDLIVHSRTIRLIPVLARVSTHSIITAHRIQHII

SEQ ID NO: 3982 - protein, 173 aa, Homo sapiens
TISQVQQLGAVVSAHDQLTSSLHHRFTLPTDHTHIFSLPLPHKLWLHMGKHSLPQECNKLQPMPRTHSQDSRTAFPHMASRLKVDCHSLSHLDRQDFSAMAQASVPLNLDRHHTATRCKVAVLQHHQEYIQEIIHSQIPLDLIVHSRTIRLIPVLARVSTHSIITAHRIQHII

SEQ ID NO: 3983 - protein, 172 aa, Homo sapiens
TISQVQQLGAVVSAHDQLTSSLHHRFTLPNHTHIFSLPLPHKLWLHMGKHSLPQECNKLQPMPRTHSQDSRTAFPHMASRLKVDCHSLSHLDRQDFSAMAQASVPLNLDRHHTATRCKVAVLQHHQEYIQEIIHSQIPLDLIVHSRTIRLIPVLARVSTHSIITAHRIQHII

SEQ ID NO: 3984 - protein, 30 aa, Homo sapiens
NWSHPPKQPPPHPNLADWRSNRKLTHSGWV

SEQ ID NO: 3985 - protein, 25 aa, Homo sapiens
PQRQQKTEETKENLVSECTEETAGD

SEQ ID NO: 3986 - protein, 82 aa, Homo sapiens
TMETLPVKTAPSQMPLFLRMKTLRLPAQYPPYILLTRDSLLGHRRTTGLLLPSPWRDSDRCTITATTMTSHPSSPKCGVSPL

SEQ ID NO: 3987 - protein, 57 aa, Homo sapiens
RKVPVKKMKLLTCPDSVSGNSSQRKNALSLIGPFTAGSLPSSRNYKMKSWTPNLCNK

SEQ ID NO: 3988 - protein, 29 aa, Homo sapiens
KKSGMTFVNRIRKHHQIVAQLYFRSFSVL

SEQ ID NO: 3989 - protein, 21 aa, Homo sapiens
RKSTMRNRGRGYRLKRFCRHT

SEQ ID NO: 3990 - protein, 37 aa, Homo sapiens
KKHDSREDCRVPTYHPHICSYWRRNRRIKELYKKVTG

SEQ ID NO: 3991 - protein, 46 aa, Homo sapiens
NPIPLLLVYLLVLGLDIASLYMVTNAICLVAWQTKAKIQTIMFPDI

SEQ ID NO: 3992 - protein, 35 aa, Homo sapiens
ETRCTFLVDGSHIRGKILRLHLMIVNGDVPVHFLT

SEQ ID NO: 3993 - protein, 34 aa, Homo sapiens
KKFKTKTKSWPLCCCNRHSIVFLEWKRWLQKSTE

SEQ ID NO: 3994 - protein, 112 aa, Homo sapiens
LLSHHQQADLPLDERVSTELQAEEQLCHCRRELRGQEPARPSIQAGTHGIHERAAGGIGKGIPLQPLLVPAAPRGDGQPAESHGTPDQDLVPEPAHEVQEGPEGQGHPALAG

SEQ ID NO: 3995 - protein, 232 aa, Homo sapiens
AQPTARRRRWPRGLLRPAAASARPGLRRALAACFRQITAQYVRPGRLHGATQQLPATTEALRSAGVRAPSHGEQRRRLRQRQLAGQPGVRGRQLRRVHGARVRACLQPGPPLAPVVGQRGLQLRRADSRQPPPWTLRPSSHLHRSLGPPLVSGTTAGGSQTDASVAAAASPNSRQNYLSCCSGGVEGGARGAVREPPSPLLPCRRLPGLRPPAAEAQATGPPLHGRPLGDSP

SEQ ID NO: 3996 - protein, 181 aa, Homo sapiens
STRRTRRPRASCTRRLASPLSAAHRSAAPLATWPTPASCRQCPAWPTTRPRRLLSPNHSPICTAWPPTRRHSAAACHNRSATQRRSSSPIPWRATAAASPAPTCRAARCTWAATSSSPWRPRPGLSSTWATSRTRRRPAWTTVAPRRFQATTTMDLATLIPPTQISRPTTRLRDDCRRLPN

SEQ ID NO: 3997 - protein, 57 aa, Homo sapiens
LHQPRGRRTPPELPPPVGGHSSATFEPWTPGQLMRLTGCPELARPLGPEPETRSPGL

SEQ ID NO: 3998 - protein, 54 aa, Homo sapiens
SQWTQEVSPSSPWSSAKTRAMSCRCGQGPCLAPPTRGPGVNGVTRSSFRPSQRS

SEQ ID NO: 3999 - protein, 123 aa, Homo sapiens
RPIHCGGYGRRYGPSPALSGSSCPCTRAAAETSRNGWVHPSLAPAWSWDPGAQRCPPPWRCTAATHHGARPRGCSSRSYKNQQSWWSLTVCPSPASGRQPRTRGAQLTVRRGIGHTAWCPLTQ

SEQ ID NO: 4000 - protein, 60 aa, Homo sapiens
PSVTYDILQAMRFTARAPSPSLRLMDVRTRVIPRTCVFWPSVSLTIRHCTMTQTLSSSTS

SEQ ID NO: 4001 - protein, 146 aa, Homo sapiens
RRSSSPRKRPRPPLRTDFLGPVLALQRERCRPRRRPAGRPCQSRSRSHSASTCPRSGRPFPVASLTSRSPPAPACSPTTAQRNGRWRWFHQQLQCPARQPRPRFFPRMEPPVGQWQPSQDGSENRIVWALMRTPRTALMEYRQHHA

SEQ ID NO: 4002 - protein, 50 aa, Homo sapiens
RTLSALSWAGTASSRGTSPRTHRNSPHCLSSTCASSASSTAVVSSVFSVI

SEQ ID NO: 4003 - protein, 64 aa, Homo sapiens
NGRWRWFHQQLQCPARQPRPRFFPRMEPPVGQWQPSQDGSENRIVWALMRTPRTALMEYRQHHA

SEQ ID NO: 4004 - protein, 49 aa, Homo sapiens
KMRRKSPRVDLKKPPMLWTCMSVFYVAVAMMKTGYCCVMAVMTVTIPFA

SEQ ID NO: 4005 - protein, 29 aa, Homo sapiens
RDAWKERASPVSGGNELRKCGPPKRRKSN

SEQ ID NO: 4006 - protein, 29 aa, Homo sapiens
NHFLSNHYIGFLAYHISTLLYSGLHQLED

SEQ ID NO: 4007 - protein, 29 aa, Homo sapiens
NIALKRYSPKLTNNVQVCSCKQQLTALNG

SEQ ID NO: 4008 - protein, 197 aa, Homo sapiens
RSSPSARPTPARCWRTSTSRSSPRTTCCTASSRPCARCCPRRPTARASSRRPCATTTTWRPSPSCRPSARRCAPTRSACCLWAARSPSGVWSSVTTPATWTPRASSGSKRRRCPPGGATTVSRCWGASSSSPAAASHGTTEGMRPPIFFIGSRTATRAPSTKTSCTSRGATTTKLAPTARTCYATTTGQTCGRSGGP

SEQ ID NO: 4009 - protein, 164 aa, Homo sapiens
RSSPSARPTPARCWRTSTSRSSPRTTCCTASSRPCARCCPRRPTARASSRRPCATTTTWRPSPSCRPSARRCAPTRSACCLWAARSPSGVWSSVTTPATWTPRASSGSKRRRCPPGGATTVSRCWGASSSSPAAASHGTTEGMRPPIFFIGMTPAVNSGSRWPP

SEQ ID NO: 4010 - protein, 64 aa, Homo sapiens
RRTVPRLTPGPMWPACQGSRTATRAPSTKTSCTSRGATTTKLAPTARTCYATTTGQTCGRSGGP

SEQ ID NO: 4011 - protein, 34 aa, Homo sapiens
EFEKDLPSQQGTREHRATHSDKRQYQLAKRCDHL

SEQ ID NO: 4012 - protein, 25 aa, Homo sapiens
RLGENKAGMACWGNSGYDIEACLLG

SEQ ID NO: 4013 - protein, 89 aa, Homo sapiens
TASTSAMRRRMEERVFVPQVISSTTMTAVPVLSLMIARYGEFVTRSVKADLAVTCATVKKGISWSVDSIAKLMIPLARPPLSSPMVGIC

SEQ ID NO: 4014 - protein, 48 aa, Homo sapiens
RWSGSSYCHISLPSAIHQQAPSVHHKSKVGFLQKFPHVSSCWAVNREN

SEQ ID NO: 4015 - protein, 20 aa, Homo sapiens
SVNGKNFFPKASTVCFYLFW

SEQ ID NO: 4016 - protein, 16 aa, Homo sapiens
PSLYKKILRCSFYTRN

SEQ ID NO: 4017 - protein, 59 aa, Homo sapiens
PLRTHLAHPPMCSGRRHWLGRTPQAGKTRQPGRPHQHVRALQLGRPHQPGRTQSLGRTQ

SEQ ID NO: 4018 - protein, 32 aa, Homo sapiens
SRNTWTTDECPTATPRSMSSSGASVPTMRLAR

SEQ ID NO: 4019 - protein, 30 aa, Homo sapiens
RPTQVSLNLTVQLHRHQQMVPRLRIWSPGQ

SEQ ID NO: 4020 - protein, 23 aa, Homo sapiens
KRKKNRKRKTSWDMMMISLWQLK

SEQ ID NO: 4021 - protein, 69 aa, Homo sapiens
ANGRAFQKYKQANESESYGFTSFPYIPSATNTQPSATRSGNREFGPTIGPCESSPLWKWTRTPAVVYSG

SEQ ID NO: 4022 - protein, 64 aa, Homo sapiens
KTCGVQIPATQTMEWMDPPALFLFTSVRLKIGVLIYLGEQKIPTKKLIIIHWRKFVQILIFSTV

SEQ ID NO: 4023 - protein, 25 aa, Homo sapiens
NSLEERTVISLLKKSKECRSSLGWR

SEQ ID NO: 4024 - protein, 19 aa, Homo sapiens
KNPRNAEVPWVGGDREARH

SEQ ID NO: 4025 - protein, 38 aa, Homo sapiens
CTHLDVESPMSIISGKCQGGPYGGNIISPTESIITHLT

SEQ ID NO: 4026 - protein, 63 aa, Homo sapiens
WKLNEGKNPRNAALLGSESDRATGHIYPGDDARTSMWSPRCPSFQGNARGARMEETLYHLQNQ

SEQ ID NO: 4027 - protein, 48 aa, Homo sapiens
GAAAIRGVRPSLVHPWITPPRSTPPRYSSWSRTSPASLSWKSQTSTSS

SEQ ID NO: 4028 - protein, 124 aa, Homo sapiens
RPQGVPPQDTAAGPGHRQPHSLGNLRPQRAPEENVEDPGCRACADGWCDVWGCPCCSSPGGGGRRYPHSERTDTFHRPPDRGEARGQSEADQGNQELHPRHQPRPGKEAGGVPAPGNQSQCRQS

SEQ ID NO: 4029 - protein, 101 aa, Homo sapiens
AARDPWTRTSRRQPGRLCRAGDPPTAPRRHGLSPRWTLCGACCPCWASPSSAASRRASWPRGGNAPLGTHPGGSLNGPSSGRGSGGKWRRQPVLQARRPAR

SEQ ID NO: 4030 - protein, 99 aa, Homo sapiens
ARSVSGSWLWPWHRRMSSSQQSSCAVWLTGSLSPPRTWTPSHWTCCYSSTQMRSRGPRPAPVSSPASRRPMWTCSRGGLPSDSGCCLRLWPAGVCGGLC

SEQ ID NO: 4031 - protein, 41 aa, Homo sapiens
LQSRGFPSPTEEDGVLQQGQRSLSDREKKCRHLLCPAGYSS

SEQ ID NO: 4032 - protein, 19 aa, Homo sapiens
GKKMSPPFMPSRVLFMSRR

SEQ ID NO: 4033 - protein, 64 aa, Homo sapiens
RKKPLGNKKANRLWKSSQDMSYQILLVTGQLIRLLVRGQKGTEKLKKLHPYKATKSIITLSHTN

SEQ ID NO: 4034 - protein, 52 aa, Homo sapiens
PGSKGGQMWYNPMLPMLLLEPHRASSSMPTGARKKTLRSYRLRASNLKAPLP

SEQ ID NO: 4035 - protein, 136 aa, Homo sapiens
CSGRRCWGWGWGLLPSWGWGSSSATLPSPKKPTHWPPRTWTWRSWRPSWGSWMPTGSGRTSENSPGSHTWPPALGMRTWCSCCCSAGRTQSQAWTRPRPPRTKCCCPSLARSSPTSWTSWAPLGASSTPATGLRRT

SEQ ID NO: 4036 - protein, 83 aa, Homo sapiens
RRAPGVLADQSCLRAGGLRSLGSLAPRNSQKSSSTSCRSARWPTSTWTSRCLPTLPLGCRGRPLSRASSSLQPKRSAHQALAT

SEQ ID NO: 4037 - protein, 40 aa, Homo sapiens
SCPTTTCRSGASRKQMRALIAVRAESWHGGRSTSRTFRSL

SEQ ID NO: 4038 - protein, 83 aa, Homo sapiens
TALGRSPWNSSLFKQTPPLHHPSTRWSHTPAQPRCSLMNQRPQVGCPSSNTKLSGEQLVKKYGIPSGMMPRKPAWRASSPSWA

SEQ ID NO: 4039 - protein, 69 aa, Homo sapiens
SAICPKATGPCGCVHLGGEPGEHHLRGICLSQCHDLMVSGWPAAAKLQLQQYQDLQHPLCQLSGGDPRL

SEQ ID NO: 4040 - protein, 128 aa, Homo sapiens
PWAGGTEAEQPQQPPKESASWWVEPLTAEGRASLRCPAASRPTPGCSPWMPTLSRPCGITPSSLTLSWRASACTAATWSASAAAPSRSKVTCAAWSWGTTASQRTTKRRQPPSTPCRACGGWTCQETP

SEQ ID NO: 4041 - protein, 30 aa, Homo sapiens
ATIRSHFVPCQLPRTGWAPLAVWISGIWHL

SEQ ID NO: 4042 - protein, 81 aa, Homo sapiens
PPSQGLGAAWPWRPWISVETRSQPFPRRLCLSSSREVCGPSTSVRIHMTAVGWMAGGPCSMGRRWPTGPWSPATSPPRSSA

SEQ ID NO: 4043 - protein, 59 aa, Homo sapiens
FWPLPCACDAPPAPPPGAASSLVSVLNPNPWFPPTTARGLCLIPTIYVLHIQERRSLIS

SEQ ID NO: 4044 - protein, 36 aa, Homo sapiens
WTTATTMRHGCCTPRWVPTALRSSIWCRTLQSLATW

SEQ ID NO: 4045 - protein, 30 aa, Homo sapiens
QRSGFLTVFLYSPRGREQPAWSLYFTSQGF

SEQ ID NO: 4046 - protein, 112 aa, Homo sapiens
LQSASIRVTKLPGYPLTRGFSLRGTHPAASSRMWMKGLPPCWATCPRTSWGPQCSCSCILRTDPSCWLSTRRFCSWRASPLTTPLSASVPATGSMSPWTPAGLALCTPGAAR

SEQ ID NO: 4047 - protein, 104 aa, Homo sapiens
KGLMGEGTPGLGNHFVLGASHPLGPHSTGLAQAPAWPMTPMPTAMVQVAMSPTGMSLEAHLSGAHTAPPQATARTQPCWRPLRAARAQTLRAHPHPAVPLPTAS

SEQ ID NO: 4048 - protein, 205 aa, Homo sapiens
PQWWPWCSLTICSQPHPAILMGHSRPLLKGLPLLPRTPLLHPCPPSPRVLLTARTLHCSTRDAALHSSSICCSWRSSPVLRGLLLQEALGAVPGPHLPVRRLLSQRPDWRRSLSPPIRTHFPAPVTCSNFCCKRTRAPAQAPQPRAPWALAWALGLVQAPMKGAAPQPASLAAARAATQANTLAASTLPRLRLGLLGAGLSLGTR

SEQ ID NO: 4049 - protein, 146 aa, Homo sapiens
EAECLRRPAEAAAESRHGPHPAGGAGGLRLPAGPCAEPAADRQRGCEGGCGGPRAAPQAAVGRARRHWLQGPLHWPADLSLPSHAEGPHRPGARHPPAGGPDRHGRRYRPRAQPPRARGRGLPARLLRRGDEPRPGGPQRRHQGLL

SEQ ID NO: 4050 - protein, 144 aa, Homo sapiens
CPHAAPPTCRLCRVPWAPHPSGGRCRRRSSGSTVGRSLRRCHLRPLWCLLPPSGPWPGQARSLPQPQMSGIVCRRKPSPSGSTSTSSRPRGTSVTCMKTSAMATTSSPCWRSSRGTACPGRRGGCVSTSCRMSRLPWTTSGTAR

SEQ ID NO: 4051 - protein, 141 aa, Homo sapiens
CRVRTLRSGQSLKMSPMEAVARPALGTHCPGTLGKRSGAGAAGVALGATGVSWTQLSGRSFASQMSGIVCRRKPSPSGSTSTSSRPRGTSVTCMKTSAMATTSSPCWRSSRGTACPGRRGGCVSTSCRMSRLPWTTSGTAR

SEQ ID NO: 4052 - protein, 114 aa, Homo sapiens
CLSTSSACRSPRAWAEREPARRTTCTWLCSGPLRARKMSGIVCRRKPSPSGSTSTSSRPRGTSVTCMKTSAMATTSSPCWRSSRGTACPGRRGGCVSTSCRMSRLPWTTSGTAR

SEQ ID NO: 4053 - protein, 114 aa, Homo sapiens
WSPRAACFPPWWLWVTLSPWPLCGTGAGDVGGRRTSKMSGIVCRRKPSPSGSTSTSSRPRGTSVTCMKTSAMATTSSPCWRSSRGTACPGRRGGCVSTSCRMSRLPWTTSGTAR

SEQ ID NO: 4054 - protein, 100 aa, Homo sapiens
WPARCPTSRTSSRPTRRCARSTKMSGIVCRRKPSPSGSTSTSSRPRGTSVTCMKTSAMATTSSPCWRSSRGTACPGRRGGCVSTSCRMSRLPWTTSGTAR

SEQ ID NO: 4055 - protein, 92 aa, Homo sapiens
WTPREPSRTRSAPSKMSGIVCRRKPSPSGSTSTSSRPRGTSVTCMKTSAMATTSSPCWRSSRGTACPGRRGGCVSTSCRMSRLPWTTSGTAR

SEQ ID NO: 4056 - protein, 90 aa, Homo sapiens
APGGAGGHRLRHRPHQGTEADGGGGCAYGHCGPRVQGQAAVGRARRHWVQGPLLWEAHLPLPGHEEGPDPEGPWHPPAGGPDRHGRHHRP

SEQ ID NO: 4057 - protein, 81 aa, Homo sapiens
RSCPMSGIVCRRKPSPSGSTSTSSRPRGTSVTCMKTSAMATTSSPCWRSSRGTACPGRRGGCVSTSCRMSRLPWTTSGTAR

SEQ ID NO: 4058 - protein, 77 aa, Homo sapiens
MSGIVCRRKPSPSGSTSTSSRPRGTSVTCMKTSAMATTSSPCWRSSRGTACPGRRGGCVSTSCRMSRLPWTTSGTAR

SEQ ID NO: 4059 - protein, 166 aa, Homo sapiens
AAQGRQDDGQGPFGAGLRADAAAGQWLPRRHLPGGHQGEGVHLRGHAPGPAESHNGCAPAGGAGGHWLPGGPRAEPAPVCPRGREGGRGGPRASRAAAVCREGRHRLQRPLLGQHHLPLPGHAEGPGSPAARHPPAGGPDRHGRHHRPRAQPPRACGRGLPARLLQ

SEQ ID NO: 4060 - protein, 101 aa, Homo sapiens
RHLIVPHLPAVSSWAPMQLPSPDTWQPHISARAWLGGRGLGEGPPQPPGAPGPLLPRHGHLRRPPSPSHHLPQPGGSAMPRRLTSTWAGVGGCGQPRPRSG

SEQ ID NO: 4061 - protein, 84 aa, Homo sapiens
AQWALRGIQPLGPLQPAQPPGQSPFQGLPSAYISLRWGSQVQPDPQGWSVWPGRSWRQNGPMSGTSAASWRTTWALCWTAGSWG

SEQ ID NO: 4062 - protein, 72 aa, Homo sapiens
ASPNLAQASGVAEEVKCVTVAPCVRLGQVQPDPQGWSVWPGRSWRQNGPMSGTSAASWRTTWALCWTAGSWG

SEQ ID NO: 4063 - protein, 160 aa, Homo sapiens
HVPRSLSPWVLLSGFKLPYLCQSREAARMARVYMFPICLSKTFRASTFQLLPFCLSKEVPGMSRLQPPHLCPSKKAPCTSRCRLLQLSLIKATQKSKFQPPLLCLSIEVTWLYQLHPPPFVLSRDTVRTSTFPPLQLCPRRFVLISQFQSPPLCPSKKVT

SEQ ID NO: 4064 - protein, 92 aa, Homo sapiens
CTAVPTPWPAGPGAAAARATASRGPSPSVHPRAPPRTARGVTARSPSGDGRGRLCRCQEGSSWTLLAGRQASAAYVETVHTAASEAPGFPHT

SEQ ID NO: 4065 - protein, 285 aa, Homo sapiens
ASPGGTAAPFPVASTWWTTPGHPQTWSMTLSPTTRPGTSAGPAPGMSGPPSGPGAPAAVSPTHLLPRSSVTPLAVAMQGSQTQKMRPPRSQVTSPPRPAPPKPGPTLRSRPPGSHPPKRAWRPRGAACGRPRRRPCSATWGTSSRPQPSPPPQPRSSPHRMGAAPRRENPRRKKPGPHLPPAAKTGPRGRTRPRTRAEGGLWRSPVRTRRARRPAAPGARQSGRKGPRRSHLRPLLWPPQGKGGLTGQRGGRAPQAGTPDRRPAEAHPAPSSCPTGRAPRPRRGS

SEQ ID NO: 4066 - protein, 158 aa, Homo sapiens
CYAPLASSGPLTAPIGLGRPGGPAGGPTATSGTAGPGAPARPVTAERRPPQQGWVTTPTTLSCPSPPRRGRMAPWAWGRSRARMCWSWSWSTRPSRPCAVRWSWSSGATGSCWRRPVSTAPPRPPPWRPAAPTPAPLWARTRMPSHWPSTTAPAATAY

SEQ ID NO: 4067 - protein, 118 aa, Homo sapiens
SAPLPSPLGSGPWRRTCCSGCFVRILRSDWARGPRGHKKSGTIPSSRASIGWLWLPGRFQPHSGPKSAQSWMWATLRRNSLGWSLSTHPLAAPHLGTPESFRDTPLWHPPFSLTTTTR

SEQ ID NO: 4068 - protein, 63 aa, Homo sapiens
RAWRMHPWPSGGSRSCGAPPPPAGAPLHQPTRAEPPSPPKGPPAEPTAPCPPPNPHHCDPLPS

SEQ ID NO: 4069 - protein, 58 aa, Homo sapiens
SKCCWSASHISRSYAHPGTTLSTATALSTSPAVSLRNRGVSNVSTSAACCSSYFKRLP

SEQ ID NO: 4070 - protein, 29 aa, Homo sapiens
QVDKNSWLEPRKNTSQNPKAKLPGSSLQW

SEQ ID NO: 4071 - protein, 93 aa, Homo sapiens
TRWVTPSHKCCSNSLQLQYHCQASLHSHSHIFQVASPSMAYSNLLVKQACHHLFQSPILKVPQGLLLEIPSSMCSLCQQKKLPRNLFQMSTSF

SEQ ID NO: 4072 - protein, 129 aa, Homo sapiens
ITRRVYPARTCCLDPARAMTACRRGHMGASQTAPRHPSPPALPPLPPPILTRWNCFPQSCPPASPLKRDPQQGQFIPSQPPTLPWTLRKQPQGPSCSRGSQRAVRGTSPSQGILGSTGCSLGSRLHSWC

SEQ ID NO: 4073 - protein, 93 aa, Homo sapiens
MVPLPQRTGPPPRLPRCPHPRPLVGGSSVSPTPGLRLWTLPAVFASTWPPTPNMRGPGPRLPSPAVLLSSSCSTLKPRWPGPLAPCRHPSWLP

SEQ ID NO: 4074 - protein, 114 aa, Homo sapiens
MEKPFQLNSLQPRCPLRDHLPQSFLQPEDLIRNCLLIDPLLTWIFRKNKVTWQLDSQKPRVKFLKIKIRCYPLVPNQDTLSTVNTCCLCLMELPMKILSLKTPENSLVSVGMYL

SEQ ID NO: 4075 - protein, 91 aa, Homo sapiens
MEKPFQLNSLQPRCPLRDHLPQSFLQPEDLIRNCLLIDPLLTWIFRKNKVTWQLDSQKPRVKFLKIKIRCYPLVPNQDTLSTVNTCVGMYL

SEQ ID NO: 4076 - protein, 77 aa, Homo sapiens
WEESANSCPAAFAAEEICFLRKPHLPFSSTETCHCSSPTRRGITSQSIQVTGRRAPSQPPSSSSAEQALGGHRSHQL

SEQ ID NO: 4077 - protein, 69 aa, Homo sapiens
NLSLFLPDSQGHHKPKHTSHWEKGPQPTPQFQFCRASPWWTSISSALMMMFCPPHRGTWLKNLLVQRWF

SEQ ID NO: 4078 - protein, 36 aa, Homo sapiens
LNLGQKTVPQTSLPQLLPAPQWGKESSSMHPSASRW

SEQ ID NO: 4079 - protein, 33 aa, Homo sapiens
GPPCPPWTPPPPAPRCSPSSHSPRTMAPASPVR

SEQ ID NO: 4080 - protein, 103 aa, Homo sapiens
AGDTPYDLLDRDLRVPPGPLHHPLLGAHPHPTAPGPWHQPHLSGDLPWGQRDHEQDRPSQRVLPASELDHDCLPRRRHSIHSLGKWLISVTPRGPVSAPGLCS

SEQ ID NO: 4081 - protein, 43 aa, Homo sapiens
LWLAVSLLPSAHGQSQDVSQFFLWSSRHTSLRITHKRHGSIPL

SEQ ID NO: 4082 - protein, 30 aa, Homo sapiens
LQSSTKSSTCPAHCPPTSTTPQATSATWRS

SEQ ID NO: 4083 - protein, 106 aa, Homo sapiens
QQSRSQCPSFCSRCAAPSSRCCFQTRSSAGCGMCLLPLACSLVSTCWSSLPPTSWASLGSSVPHLPHSSSSSSLPSSTSESCPRRRSLQDPPPKSWPCVLLCLASC

SEQ ID NO: 4084 - protein, 102 aa, Homo sapiens
WRRLCRQRWWSWCPMANTQRGCSRSSPPWQATRGSRTLHGAVWRARASYRKVPARSHTSLTSRGRHHSGCQCSTSAMPSWAAASWDSPMPWPIRALSFSCSC

SEQ ID NO: 4085 - protein, 35 aa, Homo sapiens
KHKMALTRNVKKMFLIQRELLKTLNMIQVLMSVVH

SEQ ID NO: 4086 - protein, 32 aa, Homo sapiens
LGHRKKHRNVQCHDAVEENGQSSFITSPILHS

SEQ ID NO: 4087 - protein, 30 aa, Homo sapiens
LGKKHRNVQCHDAVEENGQSSFITSPILHS

SEQ ID NO: 4088 - protein, 47 aa, Homo sapiens
PLARPPPLPLTCRRWRARSTASSASPRRWTTARCSSTTRPTSSRASR

SEQ ID NO: 4089 - protein, 197 aa, Homo sapiens
LGRRVGRQLHGGGRAGRSGQRSIPGPRRLVFGGCGRSRPLPPVHALRPVPGFPRRLGPPAAPPVGAQELGHREPQPQSLLHLRQVRRGGLRAGGGVRLREGRGQAVRGAGALWPRVAGEPLPVPVHHRRPHQADQVQGHEELHLLQAGAHAHAGAGASALQALRLAVRAPGGEVPGHLRAPPAREAGHRPLRGGLHL

SEQ ID NO: 4090 - protein, 108 aa, Homo sapiens
CGLFWALPLSPIFIRSSGTSSLWPTGRSCCACWCSSRWAWCSPTAVATETGVSSGASRAAPSSPSSRIFSQACLSLASSGPNPPLNQKIRSSSRPGGAEKEPIFQKQA

SEQ ID NO: 4091 - protein, 47 aa, Homo sapiens [sequence omitted]

SEQ ID NO: 4092 - protein, 110 aa, Homo sapiens
SEYEKLSHLSQQLLNQSLERAMKEKAVDLVPILAQNPGLAQNPILEGKDHNQNTGVDPIIDHVQDRKTDVDLRAHIKNALNQGRDGSQGVVRIHGTREKTLEKRSRKRKE

SEQ ID NO: 4093 - protein, 58 aa, Homo sapiens
KTGLPKGRSLSGLHRGCLMLRRSGPWGVMLPLMVTSSSLRGTVTAGRAFCSRASPCLL

SEQ ID NO: 4094 - protein, 191 aa, Homo sapiens
PRPMGGRPCMAPRRPCMALAPEHPCTAHRHPSRMVAAPHTTAHRRPCMMAAALLPRVGPGTPTTPTRRHGLRKNMSMLSMMSPPRPRRPMGEPPIPKHLATQTPRPHRSTHNTTRRRQGRRPCTTQTSSLPMLPPPHKVPTSPAPAPRATTRWRQAQQATRIPTPQPATTLHRRPWPIRLAPARAPLATVL

SEQ ID NO: 4095 - protein, 100 aa, Homo sapiens
WPSRYSGKPSPACGAGRNFPGKSRTPRSAGLGYLALGSPPARSGTTPSLRKTPDLQHLSPRGHSLAQLSQRAWPPKVQPPPAPQPKPPAPSPRAPPGASP

SEQ ID NO: 4096 - protein, 85 aa, Homo sapiens
RKSFGMPLSGTVQRSAYLRTCTPISMSSLASSRIIFESCPPHSSPSPCIRWYWRPWPGTPQTEFPPPLRAPEGSSAACQMWKGPR

SEQ ID NO: 4097 - protein, 71 aa, Homo sapiens
GLGYLALGSPPARSGTTPSLRKTPDLQHLSPRGHSLAQLSQRAWPPKVQPPPAPQPKPPAPSPRAPPGASP

SEQ ID NO: 4098 - protein, 169 aa, Homo sapiens
GHPRAPQLPARCGKGHADASPGPPAPRLLLPCLQPHDPTELGRVLRACAAAGTPGAHKASCPQLRPRPCQCSGLQAPHRGAALPAAVLARSPPAPTISRCRALLATQTTATSAPAAGRPRSGDSAPRSRRPRKPPEQPLRRRLERLRAGLPALWAGFPVRARLRPRDGQ

SEQ ID NO: 4099 - protein, 132 aa, Homo sapiens
LGPGAPPSRGPPGPNEAPPPSWTPASERTMDLVSPSLNCLMADASPANRHRTLLLGLGDLASFLARTRQWGRRRSSVVHTGSGTSMEEGHRVGHVRTHGTVLVPRPSQVPKPAPKESGKGLAESRDPRGHQE

SEQ ID NO: 4100 - protein, 203 aa, Homo sapiens
RCSAGKASRLPCAPDAGPCCVGPMCARRTALAPIRSWQRPLETHSGWRPLAGTCTVNSLCTRCLCRLRATGSRGSCRCSRPTPCIDRSRATARPRGPWLLCCSCTCPQRRPSGAWCRSVRSTSLGTTGPTWRLCGWTPRCSWPCCGGCFRTCTSTCSRWASDPCCTCPSGSCASSPAPCPSPQCCVSGMPSSVRVPEYCSVWG

SEQ ID NO: 4101 - protein, 11 aa, Homo sapiens
KSRSLGELFRS

SEQ ID NO: 4102 - protein, 71 aa, Homo sapiens
SRDETEGTGRAHVFMGHFKRVYKCLQVTSGRGPSIFKLYSSCPTAFRGSEARHQWQLPNPTKISKNAADSL

SEQ ID NO: 4103 - protein, 60 aa, Homo sapiens
GDTRSSGPRSMSDGQGDSESRCSLPCSIYGRRGQQPQHRSAKPLQFRNQRDLLRLLDFGR

SEQ ID NO: 4104 - protein, 118 aa, Homo sapiens
KARFRISESCFKTYFQIFPGYFLFIHWGFFDISWITTGSNASGCPEFGNRKNYTNFTSYQLLGTFIYGSALGKTNHQRLHYEPTTGQRKYPFNDRSHIRYSATLVNNPAVCFAVGHDA

SEQ ID NO: 4105 - protein, 30 aa, Homo sapiens
KICLCHLWIFFLCQSNGSVDCNRKLSGIWT

SEQ ID NO: 4106 - protein, 15 aa, Homo sapiens
KIFLLLFFFEDFCLF

SEQ ID NO: 4107 - protein, 40 aa, Homo sapiens
TKRPSVWCAENPGATNSTAWCHWRRWCRSTRPNCRGTWNH

SEQ ID NO: 4108 - protein, 79 aa, Homo sapiens
RWAGGGAGRWVLPVNQPIIRKRWALGVPPWAAGMPAPRAITIAAAGSTCPSSPCSSGKCGAWAPTANAIRPRAPQNRRC

SEQ ID NO: 4109 - protein, 67 aa, Homo sapiens
SWAPGLLQRRDSSPRAHLLGCLPGRACLSFLPGALQGHPHQALPLIILPPAGAPLSALGGWVVEGGP

SEQ ID NO: 4110 - protein, 32 aa, Homo sapiens
LEPTNNQEEKEKKTRLFARGTVLLERRRYYWC

SEQ ID NO: 4111 - protein, 18 aa, Homo sapiens
PRGKRKKNKIICKGHRIT

SEQ ID NO: 4112 - protein, 46 aa, Homo sapiens
KKTTYAVNVGKRLSRSLSSLIMREFIQEKNLMDVLCVQKCSPESPG

SEQ ID NO: 4113 - protein, 23 aa, Homo sapiens
MNIKEFIKERNLLYAVNVEKSSL

SEQ ID NO: 4114 - protein, 45 aa, Homo sapiens
EPRFGLQGHTILHHTTRSMAGLLFIYRIVLKEQSLNCKLEGTPRK

SEQ ID NO: 4115 - protein, 21 aa, Homo sapiens
VCPKKIWRLEFWAAFDKRPSF

SEQ ID NO: 4116 - protein, 65 aa, Homo sapiens
ALYLSYFSCLGMQHFPGCTCWLGSSMKQEWPSSLTSVSTCFLALIPLFPCQWYTFFPRKSLMIRL

SEQ ID NO: 4117 - protein, 55 aa, Homo sapiens
YQRWCTTKFLLCGCPQPGPSCLSVVYHFSNIVYWVGEPKLKSTNSPQHMASFSGT

SEQ ID NO: 4118 - protein, 34 aa, Homo sapiens
RIQTTLPTYFSQLPTDGWRSGRIIWELALSSLHL

SEQ ID NO: 4119 - protein, 30 aa, Homo sapiens
RTKEKSCRSSKSDSIYMACNVQSFWATNST

SEQ ID NO: 4120 - protein, 38 aa, Homo sapiens
GLPPSVECALSTEVVPSMRTQDLALPSPSLMSQGTTLV

SEQ ID NO: 4121 - protein, 20 aa, Homo sapiens
IFFCNVRQSERWNSLLPKQK

SEQ ID NO: 4122 - protein, 39 aa, Homo sapiens
GQSVKIRKLFSKLIKIHMWLTWKMAILKVFQKGKRENRM

SEQ ID NO: 4123 - protein, 71 aa, Homo sapiens
QMLLNPPLRLCSKNPVPPPIMMQRISSLFLVKMQPPNEPSEIALIITRTLPRSLHCQKEDFFLKRKLLRMI

SEQ ID NO: 4124 - protein, 57 aa, Homo sapiens
ARRTAPQTTAGGPATQTPTLRLTSQTTDEGPAPQTTAGRPASKIPDWRCLTQGSATL

SEQ ID NO: 4125 - protein, 96 aa, Homo sapiens
MRAMMIWMTNQALSRKSAHPDLRASATPPASPPRTSWHCQDSALQGTNSGSPMEPSPTRSSFPQAQTRPHHQPRRLPLCLLGTPGKVQLAHLQHSL

SEQ ID NO: 4126 - protein, 132 aa, Homo sapiens
LAWRMWPVPGVQMRLMSYRLTCPSPPARPHPVKTLALPSPASGAWPPSMLKLSITCCWSERTPAAWQAPAAVEQGIPTAAVTVIVLLGAGPPPRSGPGWGTLEEEVGTCLQSQHPMKVPAEMETQLPRDWLA

SEQ ID NO: 4127 - protein, 86 aa, Homo sapiens
LLPSTAGSVPWPSAEVKASPAERQHWFPPLQTIPPHPTAQCQRTRTLSWCSFAAMSMTSATGASLRTPSSLLMPMLGLPMGKWGSG

SEQ ID NO: 4128 - protein, 82 aa, Homo sapiens
SESQGSSMASPPRRGSKTGNGNFCQKKRKGRGERETVEEEGIVAKSREEKKNKKILGQEKTEVARNGNERSSASRRTEEINR

SEQ ID NO: 4129 - protein, 57 aa, Homo sapiens
PVLSNNPEFSNKRPYLNNWKMKKENMMSMSKATRNCQRSYLSYSKRRKLYVKNICDY

SEQ ID NO: 4130 - protein, 32 aa, Homo sapiens
AKKKMKCLKVSGQKRERERSSWHLVLTLQRRP

SEQ ID NO: 4131 - protein, 40 aa, Homo sapiens
LVLVGLPCRPECPVCPPRREGPENQAPFRDSLWKLGQPPM

SEQ ID NO: 4132 - protein, 22 aa, Homo sapiens
DRQRPRPGHLKCCMHPGGCVCP

SEQ ID NO: 4133 - protein, 22 aa, Homo sapiens
GIKRLEGPPSLKAPTPWDATIQ

SEQ ID NO: 4134 - protein, 48 aa, Homo sapiens
LLYGTVHLNCYWEKNDTHQPLMYGAVAVSLANSSLKNLYFKQIRNLHN

SEQ ID NO: 4135 - protein, 36 aa, Homo sapiens
RENQTTYTKHRSQGEGATCSFSHLYITTVTFASHAA

SEQ ID NO: 4136 - protein, 33 aa, Homo sapiens
KKYVWIMKRKAFQLQQFEKLKFSGSLPIRVLSI

SEQ ID NO: 4137 - protein, 19 aa, Homo sapiens
NKKRQKKHFIQIKLLNYLM

SEQ ID NO: 4138 - protein, 56 aa, Homo sapiens
QLKDHLFSMQTSWILYGIHFRINQLLEERWSFYFQMDWMMMLRNLNKNLMNLEKKA

SEQ ID NO: 4139 - protein, 33 aa, Homo sapiens
NHPRAGDFCHWRPGGPIEPCSPRLPTQHSEESS

SEQ ID NO: 4140 - protein, 28 aa, Homo sapiens
TKIPALSMQMLCFWWTALIAWDPSPSHL

SEQ ID NO: 4141 - protein, 28 aa, Homo sapiens
GAMQNSCTKLACWMRSKKSTSRSSAMNA

SEQ ID NO: 4142 - protein, 49 aa, Homo sapiens
KTVMVCLPLCDCFERLVIWTLLKLLPEPCGIFHPMTQSKWRLWTMHCMP

SEQ ID NO: 4143 - protein, 20 aa, Homo sapiens
VVLQREKTYRGSSKRYSGFP

SEQ ID NO: 4144 - protein, 76 aa, Homo sapiens
DWAEGFRQQACRELCLPSSELIISSSPGDPTGRALPRGSSQCCQQYWATCCQLLWGQEGQREKTYRGSSKRYSGFP

SEQ ID NO: 4145 - protein, 61 aa, Homo sapiens
DWAEGFRQQACRELCLPSSELIISSSPGDPTGRALPRGSSQCCQQYWATCCQLLWGQEGQR

SEQ ID NO: 4146 - protein, 97 aa, Homo sapiens
TMGHSPHRSSGRKNQRPNKPKARGCPCQRAAPQALPPTFRVSTCQKRPSQPRKNMLGVPPLGQGSPLRKALSSQGPLQKRVLAEALPRRRRTKLYSP

SEQ ID NO: 4147 - protein, 72 aa, Homo sapiens
KRCHRKTACRASPRPLLPCCLQLSPWKRGLPWISRARALPKAWRKRTWSRPSLSRGSSPVSGSTGATGTWAS

SEQ ID NO: 4148 - protein, 52 aa, Homo sapiens
RASVMRPSQAPRSSMFLPLTRTLGYMGQWLMSLFQETCRPFLPLTPPQELFT

SEQ ID NO: 4149 - protein, 24 aa, Homo sapiens
MNLSPFSLKISIFSPSQKRIKTDS

SEQ ID NO: 4150 - protein, 86 aa, Homo sapiens
VRMLWLEARLLHFQTSTMTGPVKTHMLNIPSSVVIHRTIFMWKLSSFIQNILISKSVILCCFTVWTEKQVLAMSLSFWHLTVAALH

SEQ ID NO: 4151 - protein, 19 aa, Homo sapiens
ASTSQKTEWSNWKKGSCVN

SEQ ID NO: 4152 - protein, 67 aa, Homo sapiens
GRITPLARSVRGPMGRIEIETGIVKIGLKIETENVIEEIESERGRKKRRRSCELQQMLCLSVLDYHL

SEQ ID NO: 4153 - protein, 66 aa, Homo sapiens
RAREGERKGEGVASFNKCYAYQCWITTFESFPFSSLNPLSTFNAFNTFCSFNACRTCRSHVTSTVH

SEQ ID NO: 4154 - protein, 46 aa, Homo sapiens
NRKEKRVRERRTVLGVRSKDSKQRSRELKRGAGVSWRILPGRHSHS

SEQ ID NO: 4155 - protein, 32 aa, Homo sapiens
KISLRPRSTSPRPPSTSSPCRRKRIPVATGLR

SEQ ID NO: 4156 - protein, 84 aa, Homo sapiens
GVPSVRAQHRTGGPASPVGWACTSRRGPGGSPHLQCMSMALNLMPTTPLMWKPKMECQGWAALAMPAPQSASAWGMQSHCQACL

SEQ ID NO: 4157 - protein, 79 aa, Homo sapiens
DGATVSLAMRKVAVAKHVLPALAAPTGWTWTHPIVSRAPSRALLSLRGPPSVPVRAAITELPGRAPRWHAQVPPRPPET

SEQ ID NO: 4158 - protein, 43 aa, Homo sapiens
TRVILGSLARSLQFLGAVNGAPVQSLYTQCHGDAWHQSHQRGM

SEQ ID NO: 4159 - protein, 99 aa, Homo sapiens
DNTGGHWGHSCCSTGEYKLPRECTTLRNMVWCIETWLPETCYSSHPVRFRWQILVWLTCCLLMISSCYTVRPRLQLSGWPLRVSTLGNTHTRVMSGAMV

SEQ ID NO: 4160 - protein, 80 aa, Homo sapiens
GQEWTAEFSSCDRSYAGHWQPGPCPHCKAAGTMPRVISAACHSIFASGFSAGSCETTPGGTGATAAAQLGSTNCQGNVLP

SEQ ID NO: 4161 - protein, 40 aa, Homo sapiens
PRRSPRWRGTPAWTARRPSSGSRSSSSAGRMPSSRPGWKG

SEQ ID NO: 4162 - protein, 120 aa, Homo sapiens
TCVSARRPSCSTWRTTAGSRKRPTQSARPWRSSTPTWMPSTALHLGAPLAPPQSCCNSWRQRKNGWPSPRGPLGTCSGEAGMWPLCHSEETPLSSPCTWTASATGTQEKCSCCRVSGISW

SEQ ID NO: 4163 - protein, 22 aa, Homo sapiens
PGGSSTPRGQAASPSSRPSSPG

SEQ ID NO: 4164 - protein, 170 aa, Homo sapiens
RQYPGPPHHLVWLSSCGSRAWVALSLQAQPLAHQGFLHPPPPALADGLPLQRSLESWKTITWSICVRHVVVWTAVSEPAVPGLPPMMASGPLLSPVLLAPGLRNAAYCLRRTGTTWGKGRRKSWGGGGGLGVQGRALVTCPLPSSMECQDHGLRGPRRFVWCQRRELGNC

SEQ ID NO: 4165 - protein, 69 aa, Homo sapiens
ADWPPGALGTVYLKGPISKPQSWLIPRPASWSSRITGPRWCESWSGKALGQLLGVQTISVLCATTLTRC

SEQ ID NO: 4166 - protein, 47 aa, Homo sapiens
QRSHRFHRPRPGARAPCLPGPPRRTCLGPPNERKGRQGMSLPPQGKR

SEQ ID NO: 4167 - protein, 124 aa, Homo sapiens
VRTKPPARPGMGDGQPGAALARRRTVGGGGLCALAVGGPYSAGPWAQPHHPGLHSWSGTWCGPRLEALSPTHSPWLLDPTTPCPGPPGFASSSTSGRGSCVSACESAELGAAGAMTSVCGLEWT

SEQ ID NO: 4168 - protein, 35 aa, Homo sapiens
DQAQCPPVRRGGDVCGNAGPETSVAERELERDLLG

SEQ ID NO: 4169 - protein, 104 aa, Homo sapiens
TASTSSSWTASPSTGRTSRAGRTASATTSRSTSASSRCPATTRSPARAVTGPWTRTPTTCSRTAASCGAGGASKRRTCPRRRRSGPTSRSRPRRRPRAPRPPPT

SEQ ID NO: 4170 - protein, 150 aa, Homo sapiens
PQAPRPLRDGLLPCAASPETGWIAAGPGGPQEAGEPSCRSPALPGGPGARAARSRLCCLCAGIETGSTHGCQGAGAVGARAGAPPRLPVPAALQHPGFPGSPAPVQSWAPHRPASSAHPCSSTRSRSSSCSGAWKRSSWPMPGPLRLLLA

SEQ ID NO: 4171 - protein, 107 aa, Homo sapiens
CLAPSWRATTWPPSSAGAAWSWVCRRCSCLRLRTWCCARTRRAWCCACWRWRGVGHAWACWPHASCSLSRRLSGSCVLHPQPPTPLPLGRTPLKPPPHQGLLPAAPA

SEQ ID NO: 4172 - protein, 85 aa, Homo sapiens [sequence omitted]

SEQ ID NO: 4173 - protein, 121 aa, Homo sapiens
SSAAAGTPGDREILQETFCEPEHPGRSRGQRFLRDPPGTCRRPRAVTRLQAEGRRRRQPDPRDLQPGHLAPGGGKVLGVRSLLKLWGEGTPRPSSSSFRSQRRKRRVPEALAFPGVARSRV

SEQ ID NO: 4174 - protein, 74 aa, Homo sapiens
RQSPEPAIFFTGQGEPGNSRVPTTSPCPRRPMDWRGTKGGQLHSRAGRWPRMDPWVKESMSLGVPAGETARTGV

SEQ ID NO: 4175 - protein, 146 aa, Homo sapiens
REERSLQSREEVEVEEASLGSRGWVLALTASGVPAWSAWARAWATAWIAWAPRSSAWAWSWTAWAPWSAWAPALSAWARWASTTWPPALSAWARPWSALALAWSAWVPAWASALSAWPLPSTVWARPLSAWALAWSAWALPSSAWA

SEQ ID NO: 4176 - protein, 95 aa, Homo sapiens
AHGLWRGAHGPCHRAHGPEHGAHGARRYGSWPGAHGPRDGSHGHRPGAHGRQQSGADGPGAHGRQQPRAHGPGAHGCQQPRAHGPCHGPGPGRWH

SEQ ID NO: 4177 - protein, 100 aa, Homo sapiens
EDLKRIVLKKSLKRRHSKMIVKRMALQRNLKMTSTRSLKRRLAPQKSPKKMTQRKSLMKTALKNSLKMAPKENLKKMVSRKIWTRKVLKRSFMKMFLTKS

SEQ ID NO: 4178 - protein, 164 aa, Homo sapiens
MRKALRESLTKIQMKRKKRRIHMKKYLMMSLMRKRMKNMQMKRGLKLLIKRRKKVMQMKSCLKSQMTRKMKMQMERKLKMLTKSCSKMMIPMRSCLMRRKIPVRSCLTILMRGGLWVVLGVLKKGPYPLAAALFSVAMMMTMIFNPLNLLFRESPPSTFACASG

SEQ ID NO: 4179 - protein, 52 aa, Homo sapiens
SNCHADYERKMPPLLEVYSGVFRYTVSSMCRSCQWKIVLTAHSSKNPPDSTG

SEQ ID NO: 4180 - protein, 22 aa, Homo sapiens
DCSQGIVKKGEIYSWISTEWHG

SEQ ID NO: 4181 - protein, 80 aa, Homo sapiens
WNNTAVISGGLFPLNNFFQKKSYLRLVALMPWNMCQVRIFWTSGLIAELHGLMFFQVLTKEQICTWKEKTSSGVGFSHPY

SEQ ID NO: 4182 - protein, 48 aa, Homo sapiens
DPRNGEKNNVSCYSGYTDTVLPCEGFKHQLEGEIQWKENHHHIRLFGI

SEQ ID NO: 4183 - protein, 103 aa, Homo sapiens
KDQPYQERGRRKWMLLHLHPPQAALSKLKEQRQLLELRKEKNQPKKRLDPKGVRCPRNRLSLPLLQEPACPQPWAVPHLPRPHCQLHPTVLQLRTRKQWPNVR

SEQ ID NO: 4184 - protein, 46 aa, Homo sapiens
KKLIKLMKIIKNTVPKLAKIQEIILMKMKAKVKQVKNYSRTLYDQK

SEQ ID NO: 4185 - protein, 24 aa, Homo sapiens
IKAVFLVTLYVRKQNQEIPLKFGL

SEQ ID NO: 4186 - protein, 57 aa, Homo sapiens
GAGAGTGLPGEDKHTEAHTPGSVLWAICARGTSWAVNSAGSGGNPVRLGRGGWSSLC

SEQ ID NO: 4187 - protein, 49 aa, Homo sapiens
GVPRQGTQAPTTALPLSGFRILMAAGPRLQRKGPSWPTWMCRRCPASWQ

SEQ ID NO: 4188 - protein, 27 aa, Homo sapiens
EFFQMSSRCLLPPQGPEAARPQPHPHA

SEQ ID NO: 4189 - protein, 57 aa, Homo sapiens
SLLISDALHFLINLPKSQLHSRLLKMPMSYYIWETLSQQIIYHLQEVSLGIVLPLSI

SEQ ID NO: 4190 - protein, 34 aa, Homo sapiens
TGKPNKAMLKCPFSLPVFFFKILLEYQQWWILLL

SEQ ID NO: 4191 - protein, 23 aa, Homo sapiens
NSAEIERGFSFLSGVQEFLRMWQ

SEQ ID NO: 4192 - protein, 135 aa, Homo sapiens
SLSVHAASCPRRLVPCMCCCPLGAPGPPSAYLSPLGTTWLRTCACRLPRPAASCLCTTPSLLWPRRTCPAGSPRATSSPWRMPAPKSCCTGFAFTSPIGLGWRSATASGYARIWPVLSLTCQSWSTSLPSTAVTW

SEQ ID NO: 4193 - protein, 48 aa, Homo sapiens
RRPCGSWDCSSSSSLLGSSFSPARSTLPRQTTPLQVSAASRMPSGGQW

SEQ ID NO: 4194 - protein, 190 aa, Homo sapiens
GTSTRSATSTSSTATGPASTPSSTTISPGAASAGRSTCPSTFSPRRSASTSWARRPWRSSARTRASCGRRSGPCPAATSSARCGCSSSTPRAPGRPGASPSCPCWSSSSPLSSSAWRRCRSSATRRTTPPRRRRTHSKQPATARRGPAQEPPASPIPSSWWRRCASSGSPSNCWCGSSLVLAKPPSRETS

SEQ ID NO: 4195 - protein, 45 aa, Homo sapiens
LMVSGVHKQGKQVKLEHGFKTLQHMPRERLGLGVWSQAVSNPLLV

SEQ ID NO: 4196 - protein, 115 aa, Homo sapiens
RASFFPIATPKRTKAKHCWLWEGGKEAGRARREIPGAPSPQVHTWSPQRPEAAGGGPALALGHGEASQPRAEHSPQVSSVKTVRLGGVAERCVNHKRDTLPLSARASRWLGACSV

SEQ ID NO: 4197 - protein, 113 aa, Homo sapiens
SHLIWNCESPATQRFVRERVKSLLLPHCNPKKNKSQTLLVVGRRKRSWQSPQRDTGSPQPSSPHLEPPETRGGRRGAGPRPRPWGSVSAESRALPPSLLSENRTSGRGRRALC

SEQ ID NO: 4198 - protein, 113 aa, Homo sapiens
TEPPRNCESPATQRFVRERVKSLLLPHCNPKKNKSQTLLVVGRRKRSWQSPQRDTGSPQPSSPHLEPPETRGGRRGAGPRPRPWGSVSAESRALPPSLLSENRTSGRGRRALC

SEQ ID NO: 4199 - protein, 95 aa, Homo sapiens
KAGPPGPACAVCPTLSHTGKHGTSAEPEAGSRGAEYTTVSRAAAPPPHRGQGAPWFPGPPPQAGVHPQPGSGVPAPADTLAVPYREDRGAFPAPG

SEQ ID NO: 4200 - protein, 63 aa, Homo sapiens
SQQQPPGPHCWGARKHRPWESRGAPLRRQKPSGVLRPGPRTKGPALVLQPLANRAPHILWPSW

SEQ ID NO: 4201 - protein, 57 aa, Homo sapiens
WSAPVSGSSSLAPAPRLNTSSPSWASVSTLHGPPGPYPRSPGRTRRAQQPPNGLRPP

SEQ ID NO: 4202 - protein, 139 aa, Homo sapiens
HRTRSSVYPIMSSRRTYQRPRASNCCLGGSLSRLGPCRRLKALRTIWTCSNTALLTSCVMRRPCTGMPSTSLTSWSFTHSSSWSAPVSGSSSLAPAPRLNTSSPSWASVSTLHGPPGPYPRSPGRTRRAQQPPNGLRPP

SEQ ID NO: 4203 - protein, 92 aa, Homo sapiens
SSSISTTSGRPRSFDRSCSAMPRAGWSWPSACCRVCPTPSLSSVRWSHSGWRPSAISPSPRGCHSWCTCRSSACSTRPPGYPSPCRSSCGTT

SEQ ID NO: 4204 - protein, 158 aa, Homo sapiens
ARAEAQEPGAALPQLQQAGDPALPARPVLRPPSAGCVPQWATLPATRGGPPAEPTAPGPLLQCPGGPARRALLLPQAADVASGRQPAEPALAPRGCPQSPQPPGAQRQPLRGAARRTWQLWGAQEGGAPGGRHALPGSAGRSAGQDGGGMKLGWGRFR

SEQ ID NO: 4205 - protein, 35 aa, Homo sapiens
VNTRGTSCGKSLICPSLVIPPWGESTHGLDLDQIN

SEQ ID NO: 4206 - protein, 106 aa, Homo sapiens
ILLEILQAIRLCRNVLLQNQKKKEISWKNSPRKIPRRNWVCQLPPYPLEGGWLGIQRTQVKTYRNSPGRKRRRTTMKRKGTGKRASRLLWESKRSWMYVRNLRQIR

SEQ ID NO: 4207 - protein, 73 aa, Homo sapiens
KQLILCLCGKILKTISTNLLRQLFQFQKFQNTQQIPLDSCLLHHMFHPTGIPLDEFRALLEIQSFSTMWEKQG

SEQ ID NO: 4208 - protein, 220 aa, Homo sapiens
WKNPKISASTPCWRWTPHEPPLRRARRWPWSRRSPPPHLAPEVAAAAAGRAAGLAAAAAPRPRSRRLRPPTACAPRARRRRACWPRTARCCPSRASWARAAAAAARAAGTGGPTTTRIRAQRPLPPPPPPPPPLGAWRWGCTLGARRAARASRRRRRSTATRSTATPRRRRRLRWRASTRRSPTRTRRCKARTPRTPPTPSSWAPAPSSWTSGCARPPRA

SEQ ID NO: 4209 - protein, 153 aa, Homo sapiens
PPSHLSYPPASPVSPTESRISHLTPSHTTQASPSLTFPETPVQVFLPPPAQAGTWGLLPDPWGRPAARMRSWNLSWCSGRKRRPPRWARGDWGKNWTQRMPRHAAVWPWESPLPMALHLSVFPDLHPLGLACIRHRRDQPPHLAPGRASPPGR

SEQ ID NO: 4210 - protein, 22 aa, Homo sapiens
CIRHRRDQPPHLAPGRASPPGR

SEQ ID NO: 4211 - protein, 92 aa, Homo sapiens
WGRPAARMRSWNLSWCSGRKRRPPRWARGDWGKNWTQRMPRHAAVWPWESPLPMALHLSVFPDLHPLGLACIRHRRDQPPHLAPGRASPPGR

SEQ ID NO: 4212 - protein, 86 aa, Homo sapiens
SAKRSPYRTHLCGVSLQHRQPPLALTWTSHHPGPPTPPIPMKTLLAKLLTYQKASAMACPLCTPRRGPHHPTDRACGCSLRLGVPQ

SEQ ID NO: 4213 - protein, 80 aa, Homo sapiens
CLLQSPPSSQVQLCFCLVAQKNWTQRMPRHAAVWPWESPLPMALHLSVFPDLHPLGLACIRHRRDQPPHLAPGRASPPGR

SEQ ID NO: 4214 - protein, 156 aa, Homo sapiens
SAKRSPYRTHLCGVSLQHRQPPLALTWTSHHPGPPTPPIPMKTLLAKLLTYQKASAMACPLCTPRRGPHHPTDRACGCSLRLGVPQVVPNHLQFPSFPAPSLVTRMEGGAPLSPWGCHSLRQPPFGRLLFLHPHRLKAPSLPRVMCIPYLLRDTIR

SEQ ID NO: 4215 - protein, 79 aa, Homo sapiens
QPGSELRGGDPTQYHQQAASYPARRHQRPWRTSLTYLPAPAPQGRIPGESLLHSHPCSESGPPGEQPGLPGRRLPGLGS

SEQ ID NO: 4216 - protein, 76 aa, Homo sapiens
LAWVLPIMATQPCSACLATAPPLAVLLVVPRPGCPVGPLQEGTASTWALARMSLSSWMTGTALQSCSSAIECAPHI

SEQ ID NO: 4217 - protein, 70 aa, Homo sapiens
RQRPEAWWSSISGNERSWKKRGLGARGWRLDYSSLGRPIRLRLKSCGGSWQRPWLPSTQLRVSVSSSSKK

SEQ ID NO: 4218 - protein, 212 aa, Homo sapiens
CRGRDGSTRRRGRGQPGAGDAHYQLQGIWGHSGLRLHFPHRGALGELSRTHDGRQVPADEVGYRDLPGSHQTVQRTDPGTPCPRRYNALSPPWDLGLGLPFGHDQRGSLGSQQQWHRRQHAARGGGSSGGWCSHCRPSLFACVTWGGPLAHGGWTPIPPTADFPIPQCGIQCPSPDWQARPGPPKEGQPAGLNVWVPRGPEGGRHPSMRSMW

SEQ ID NO: 4219 - protein, 16 aa, Homo sapiens
CSFAPLGPRTWASLWT

SEQ ID NO: 4220 - protein, 22 aa, Homo sapiens
AGPPPPRKKWQQSCSSSLWTSC

SEQ ID NO: 4221 - protein, 84 aa, Homo sapiens
KPLLKICKRIRNDYKRRKQRKLNNSMKSLRSCSTSCPSWGLWCTKSATVRLAVCRASCSAPRPGALVGRPYRASSRLRWKPRRP

SEQ ID NO: 4222 - protein, 69 aa, Homo sapiens
IGKELWHKAKPLAQGPEHDSRSLHPEPESPPQPGMYPLATPGTLPEAADWQQQPPHTVGEEPLHPQIQD

SEQ ID NO: 4223 - protein, 58 aa, Homo sapiens
APCMCLHPPALTQPEASRGAGTAESTWAPRCTGCCGSQPSPWPRSPSSQAPSATCRAC

SEQ ID NO: 4224 - protein, 78 aa, Homo sapiens
AGLRVGAGPVPLMTARLRHTGSTSILRSRTAAQQPAGGPQAPGLGQKMADQAWDLHMDNPLAFQSLTMAAARPPCQPR

SEQ ID NO: 4225 - protein, 41 aa, Homo sapiens
HTRGSSSEPRYKHLSQRWHCLQRSLACCFLFIRIKESKEFN

SEQ ID NO: 4226 - protein, 108 aa, Homo sapiens
EKQPIWKYIGKEMVLVPQITHKREQFRTTVQAPLTALALSSEISGMLLSFYQDQRKQRIQLINQLKLTMAMYPLMGRRLLKAVKMEYKTMNLSVKLFDQKRQPGTQEH

SEQ ID NO: 4227 - protein, 23 aa, Homo sapiens
DLLPLDQKQVKNIVIPQYYLLNR

SEQ ID NO: 4228 - protein, 28 aa, Homo sapiens
TRWAGSPPRAALHLHRRAPGHEDLRFGR

SEQ ID NO: 4229 - protein, 94 aa, Homo sapiens
VALMSDLLWIGAPNARPSPDPLLPAEDLPLRLGEESPPGVPSTGVRSPEHRHTLAPPLISSSPRGPLGPGPPWFYCRVLPWSQLSTKAWRQIRC

SEQ ID NO: 4230 - protein, 69 aa, Homo sapiens
VALMSDLLWIGAPNARPSPDPLLPAEDLPLRLGEESPPGVPSTGVRSPEHSRVLPWSQLSTKAWRQIRC

SEQ ID NO: 4231 - protein, 61 aa, Homo sapiens
GSPPPFPTARNQGPGGPAPDECPGAAGADAQKPGMWTALPSPDLPPASHPGKDTVPSQTPA

SEQ ID NO: 4232 - protein, 124 aa, Homo sapiens
AAAAPAGPLLLHRLILQGPPQLCAHLCGGCGVRDQGWPHQQGRGHQLAAGQGACRGERRPCAGAHVRAQVPVPPALQGHHACHHGGPRHRGGTLHRLHPGAGLAATAGQGGGGDAAVLRLPPLG

SEQ ID NO: 4233 - protein, 123 aa, Homo sapiens
AGWWRPGGTSWPSCRTARPCGPPSTTCVSCCRACRPATTPSPHPPRSTPTLCTSVRWLWSTRPRLAASTRAWPPTGCGPRSLPGRTAAVRWCPCSCASPSSACPSRPPRLSSWWAPAPGWHPS

SEQ ID NO: 4234 - protein, 20 aa, Homo sapiens
LSISQLLKNTPKSLMECLWK

SEQ ID NO: 4235 - protein, 20 aa, Homo sapiens
SMESQLLKNTPKSLMECLWK

SEQ ID NO: 4236 - protein, 64 aa, Homo sapiens
TPTIIMTRSWLIVVSGVGTKAQMSVPFNRFWAPKRNTSALVRTGIKSPSVDRKRLCYMNVALVI

SEQ ID NO: 4237 - protein, 48 aa, Homo sapiens
LWDVQGTHDGWSHDQDLLWDSRLYRPRDNRLSAVWKICGLVGLWRPVV

SEQ ID NO: 4238 - protein, 66 aa, Homo sapiens
RCRPVDGTSCLTKKKVSTTTYPFRKGTRKETWNSGRNSRKPNLALLATKSSVPLKTGNNLPTTLTE

SEQ ID NO: 4239 - protein, 62 aa, Homo sapiens
SLISRMENLWTGGPMASCCMKCLPGSLHLMVKMKTSYFSLSWSTTFPIQNPCPRRLFLSAKD

SEQ ID NO: 4240 - protein, 113 aa, Homo sapiens
SNKRLQGNSSSSCHRHFSHSHLSHSLTPHLCLLAPPQCPQASWNLSQVGVKIVMCWRPPSPWNRGSCSSWRRAPAVLDSISHSRRRRNQSQNQRGLASVGATGRRQSRHSRNC

SEQ ID NO: 4241 - protein, 22 aa, Homo sapiens
CHHPSCPLQGSPHPFLRWGYPP

SEQ ID NO: 4242 - protein, 17 aa, Homo sapiens
CPLQGSPHPFLRWGYPP

SEQ ID NO: 4243 - protein, 113 aa, Homo sapiens
GLNLLILWILMTLILGESSSQPQISIFLWTKVKDLFSLMITWTVQMKLTSMWMNLIPPMKQILLSTLAMKIPQPTKILAKSQSLFQNIRPKRNGRTTGFGGQWSLENKSSALT

SEQ ID NO: 4244 - protein, 112 aa, Homo sapiens
GLNLLILWILMTLILGESSSQPQISIFLWTKVKDLFSLMITWTVQMKLTSMWMNLIPPMKQILLSTLAMIPQPTKILAKSQSLFQNIRPKRNGRTTGFGGQWSLENKSSALT

SEQ ID NO: 4245 - protein, 18 aa, Homo sapiens
SFKKYLEFAPNKQQDTFC

SEQ ID NO: 4246 - protein, 11 aa, Homo sapiens
KILERGSHQHP

SEQ ID NO: 4247 - protein, 52 aa, Homo sapiens
RFCSWSWLGGKSYKPLWFYGRTTKKQKHWIDHSIFCYLYSRGNISRVNKNAF

SEQ ID NO: 4248 - protein, 80 aa, Homo sapiens
HLSVHGCTSINGQKDLGTDAACVAQSHGICTEDAITSFSTVPREKKYDLGRSTCRTTFPDPYSCLDQSKPKCVHLPRTLG

SEQ ID NO: 4249 - protein, 226 aa, Homo sapiens
GGSQRKISGGHLRRTGDGPQRRTLGGLFRENGGDHPRMTSGGPQRRISGIPLRRTSGSHPRSISGGHLRSISVGHPQSISGDHLQSILGGLPQSTSGGHPQSTSGGHPQSISGARPRSTSGDRPRSISGGRLRSISGAPERKISGTHQMKTSGALLMKTLGTLLMRTSGAPRRKILDALLMRTSGSSQRKTLGKLRRRTLDFLTILDLLVRILGARLMILEVTALL

SEQ ID NO: 4250 - protein, 16 aa, Homo sapiens
VPPGGLQALPRGLQAT

SEQ ID NO: 4251 - protein, 55 aa, Homo sapiens
GSSQPPTWPRSPHTSSGCPPRRGRAGGSHWRPPSSPPRRESGRHPPESSWCPRQK

SEQ ID NO: 4252 - protein, 37 aa, Homo sapiens
CGNLRRSPTASSWGTRLPTAWPAAAPTPSPPWRSAPQ

SEQ ID NO: 4253 - protein, 34 aa, Homo sapiens
PPPRSTCPGASLRRPTASCRAIGWCTSPWPLYKG

SEQ ID NO: 4254 - protein, 290 aa, Homo sapiens
ITSAPWGALTAWTTPPVASRWPSPTAASTTWAATASATRPTAPSPPALALLTTPCPKPTRPPQRTSSTLWASGRLPGRVAGRPRPQATLRARRRSSVVSRPGSPVTAAKAPGQSTMPSPSWLPLGGPILGQSGMFPIRRKHHHPHLLPLPLSAVTALLPPRATRRPRALCSQRRLRHSTLRPWPRLSLVVTGDQSSPIGLGGQHTRGASGRDREARAAHRRPTQTAAGRPPRMELPVGCRPLCPAQMCASLSLLIAADTLPYTATTAPSVLTALGRSQGLPASRTTALLR

SEQ ID NO: 4255 - protein, 54 aa, Homo sapiens
QPPRASGLPIHLHQRLSFLVRPTPREFFLPRPVQFLGADEPTAHLRSLQLLGER

SEQ ID NO: 4256 - protein, 53 aa, Homo sapiens
WPARAHLCWPTGSWGRRGLPSLPMGPGVLEGRLPGSCPPSWVWWCPLSCPCSA

SEQ ID NO: 4257 - protein, 136 aa, Homo sapiens
EGGAVCAGPRHPGRPRLPALGPCTAAVWGMAQPGGPCPGEGFCGSNPLTLRAPGGSASAANLRPRVWDAITLGIQVMSLADQGVWFAQQSQTRIPCRETDAPLEAGSGQHPPLHRIGVLISGKNPKANFACLSGGD

SEQ ID NO: 4258 - protein, 78 aa, Homo sapiens
EGGAVCAGPRHPGRPRLPALGPCTAAVWGMAQPGGPCPGEGFCGSNPLTLRAPGGSASAANLRPRVKLASPAVKQMPR

SEQ ID NO: 4259 - protein, 78 aa, Homo sapiens
EGGAVCAGPRHPGRPRLPALGPCTAAVWGMAQPGGPCPGEGFCGSNPLTLRAPGGSASAANLRPRWHEAQHVGPRFLR

SEQ ID NO: 4260 - protein, 66 aa, Homo sapiens
PSHPPCARGLSICCESPASSQTRIPCRETDAPLEAGSGQHPPLHRIGVLISGKNPKANFACLSGGD

SEQ ID NO: 4261 - protein, 66 aa, Homo sapiens
SSGGPSCCSWWGTPGAPCLCCGWPTSLRRGGCMCWATSPWETSTPCPRTLYSRSMGHGSAWWTVPR

SEQ ID NO: 4262 - protein, 60 aa, Homo sapiens
SWASSSFEGFWISSFPSTTWPGLTTSSQRRKKRRQTRRGREKKGPTRTVMRSPSSLLPRL

SEQ ID NO: 4263 - protein, 53 aa, Homo sapiens
QWHFCPSSSQPQLEVCLLVYWAPGFCRKLNIKIKMKKFKERLLCKFRGEKREC

SEQ ID NO: 4264 - protein, 19 aa, Homo sapiens
KAVKKSYKKHQLKQITYKD

SEQ ID NO: 4265 - protein, 98 aa, Homo sapiens
RGTRDARTLTFCGRFPCRTWPSLTSGVRKARRRGAACPAHSAHRSAPAWTPWSDAATSTCGPCPRAFPRMSQNSIWTGTSSRWFRDSCLPSSTCSSWT

SEQ ID NO: 4266 - protein, 171 aa, Homo sapiens
SQAWCQAANPAASSTACMASASPMPPQGPCATARLAGWACTVTSPLTAPAMATSVSMGNACPSTLFPTAASARMGTRGHCATRPGPWQSPAEACSACMATARPQAPRGHTVCVTPAFRASCVSKSPSAGGTLSGTFTRSRGAMPSARPRAPCHGWSAGARAQARAAARAFG

SEQ ID NO: 4267 - protein, 145 aa, Homo sapiens
SARQAASPPTLSGTFWPASAQPRPRTSAWSDCAHMGPGTPRTAACSTHTSMIGSATGWPLWSTWGWSCCPCLPSSPCPPGCALWGAQVWRSLTQVCCWLCCSPRKGFQTQQGPAPGWGRFKRWSPSTVRWRRDTISQMTGGRMCP

SEQ ID NO: 4268 - protein, 47 aa, Homo sapiens
LQGESLLGRGPPEAGGGSGQSLKTGSILGEGSGPQSQACASPSIPIQ

SEQ ID NO: 4269 - protein, 158 aa, Homo sapiens
SARQAASPPTLSGTFWPASAQPRPRTSAWSDCAHMGPGTPRTAACSTHTSMIGSATGWPLWSTWGWSCCPCLPSSPCPPGCALWGAQAFGLFLSPLSFPQVWRSLTQVCCWLCCSPRKGFQTQQGPAPGWGRFKRWSPSTVRWRRDTISQMTGGRMCP

SEQ ID NO: 4270 - protein, 58 aa, Homo sapiens
LLPWGSRPGVEASWASWPATSSAEPRACVAPSTVLFLTPCAGSATPWARSFSWSGAGL

SEQ ID NO: 4271 - protein, 114 aa, Homo sapiens
QQRQQWQQQQQQQWQGQQQRSCGPFSATVIHPGHITFLLSLGGLPTGSNSASQGFSHLSSHHTQGNSYSSAPPPAPASTSNSAATTDGNDHANIQHHSADEDHPAAFDIPECSY

SEQ ID NO: 4272 - protein, 25 aa, Homo sapiens
FQRKKKKSSGLACLPILLRNVRIWR

SEQ ID NO: 4273 - protein, 72 aa, Homo sapiens
CFKCANGNEHNFKGKKRNQVDWPAYQFCSGMSESGDREAEADRTDKAEAGPAARTSPTANRFQKPGTEKSTK

SEQ ID NO: 4274 - protein, 45 aa, Homo sapiens
SSLIICGKCGTVTSNRTCLTTPRGSICFPVSWALHASSPGDIIGR

SEQ ID NO: 4275 - protein, 25 aa, Homo sapiens
PQPPRMDSGQCLCGMGKNIGLLPPQ

SEQ ID NO: 4276 - protein, 16 aa, Homo sapiens
SSSQKKCSQIWRKSKN

SEQ ID NO: 4277 - protein, 24 aa, Homo sapiens
RGGGRLRVLLIKCCLPQRIGGHDL

SEQ ID NO: 4278 - protein, 89 aa, Homo sapiens
AKTVPATGVFLLAFEPVRKKPFFSPSKEPPCQSHCQQGHFFHGLLHGPAHGLLIHRTIPLLGSGWGKPFREEPGLCHLREDPISTLFLL

SEQ ID NO: 4279 - protein, 167 aa, Homo sapiens
SQSGSWKRSKWRHCQQGWAQASWASHPSQHISFAPALYVALGPRLSLQATAVPVTYTLSRTCSTAPCYTAAPAIGKNRTSNWSLSACVRARQKKALFLSLKRASLSVSLPTRPLLPWSSPWPSPWPPHPQNHTSAWQRLGKTLQGRAWPLPSQGRSHLHSLPPISPC

SEQ ID NO: 4280 - protein, 49 aa, Homo sapiens
TLGHPTRCILVEGELSTGKERAGRVASSPGPCLLCVRHDCHQYTSCSTL

SEQ ID NO: 4281 - protein, 100 aa, Homo sapiens
LPPIHVMLHIVVVQTSRVSSGVLLLLSSFIPIMITFLRFQVALAFCTCFFCIMPFRWIPACLSLIPSLPRDLRLPGISGLSTLPRSPWTLREQKTSKAIP

SEQ ID NO: 4282 - protein, 20 aa, Homo sapiens
PSAHAFFASCLSDGFLPASA

SEQ ID NO: 4283 - protein, 51 aa, Homo sapiens
ATPPLSLQAPCLLHQPKNWPFLPRRPAPCGGRPAMTSVHLPPHHPPTSPTP

SEQ ID NO: 4284 - protein, 173 aa, Homo sapiens
KPLTPSLPPLGPSIEPGLCHLLPNHPAACNPPSAPTPHCCPVPPSPQGRQNHGAAPPSRRRCLRSTRTLCLFHTSCQRPVSPPRAPLRRGKRPLWESRRGWAQRRASHSTSGRPLRLPTGRGRGRRRSARRTQLPAPCRRGRHRDSLGAPCTGGRARHSCPLSDGRKMAHSHR

SEQ ID NO: 4285 - protein, 66 aa, Homo sapiens
PGMARCRRSVRMLLKTADRPGLRPWLMTGTKSLTEGRKRKLKNLRERRGETSTPSRNFRLDGTSGL

SEQ ID NO: 4286 - protein, 49 aa, Homo sapiens
RTSRQSSWFFPWGRSSQPLLPLNMRSVAGRQELPWSRKFLTSSIRTSSQ

SEQ ID NO: 4287 - protein, 46 aa, Homo sapiens
RKNISPGSKKQVQRGLFPRSRERNLPQKKRNPYCYRGQREYKLWKS

SEQ ID NO: 4288 - protein, 73 aa, Homo sapiens
QPGGAVRIEGTISEIEGKTSVQEAKSKFRGDCSPGPERGTCPRRSGTPIATEVRESTNSGRARRAGKRRLFSK

SEQ ID NO: 4289 - protein, 53 aa, Homo sapiens
RSPPHMTKMTMKLGSGTGWRPSASWTPGGPSSMCLRLSWACPGLRPGKRCWWR

SEQ ID NO: 4290 - protein, 86 aa, Homo sapiens
PLAMGRLGRVPDGEEPTPASVSSHPRLAGLPFPHPACRPWSRGPVGSGCGGPRLWPSCCGQQAWGAQGAAGRLSLSNSGSVTPTRS

SEQ ID NO: 4291 - protein, 41 aa, Homo sapiens
LRWLSCPPPTPASPWPALTLPCALWTAGSLVCSTSSDWAVG

SEQ ID NO: 4292 - protein, 37 aa, Homo sapiens
VTRAAPARPPWVRSGLQTRGVPPWTRAAFDQVTAART

SEQ ID NO: 4293 - protein, 60 aa, Homo sapiens
RLARSAVTCRPRAQAVLRVPCRCRGPAPRHLPCTSLGRLSPRVPRCPSVDQASRFQALIP

SEQ ID NO: 4294 - protein, 53 aa, Homo sapiens
RLPQVSLMGSPRAWPGWDLPPAPQGPLPALHGTRWLRRCPAWVGPPTRSRCED

SEQ ID NO: 4295 - protein, 201 aa, Homo sapiens
ASRPRAGGAGIMWPCSPCALRGGPPRPTVAFLPPMHCPTATAACPMTACSILARLVATPALPTQQLAWPDTTHPTCILGQRATRHGPYPAASAPCWAPAPGSPRLCATTTCPGPSWHPSRSARTGRSVSACCAPRPTHSSATQASMTLPAPTACSRPVCCPRAPEVPRCAMAPETTLWLGPASVAPATLPCRRHCPRCPAP

SEQ ID NO: 4296 - protein, 27 aa, Homo sapiens
ITGSHGSVPTGCTGEGWYRNSEGGRGR

SEQ ID NO: 4297 - protein, 25 aa, Homo sapiens
ERTKKPSQEREVQGRRGKDWEEASV

SEQ ID NO: 4298 - protein, 237 aa, Homo sapiens
ITLSSLKMVMSPPRLKQDYPQFIQDRNLPRVGSVNSPSVMFPSLIFLSSYTQKRSLIHVMSVEKASVTSQLFMFIRESTWERNSLCVMCVARNLVKAHICKLIRESTLERNHSNVSNVGKVSVVDQHLMFIVNYTQERNLTFVRHVGRPSFMIPSLRNIRESILGRNHSNVIYVVRPSILGQDLRAIPWFTQEKNHLGVIHVIRAFIRDQHLIGIAWSTQERNRTDVSSVEKALLVG

SEQ ID NO: 4299 - protein, 36 aa, Homo sapiens
ETFFLQGLWARLYLEAKSHHTSEDTLRREALHVQAV

SEQ ID NO: 4300 - protein, 62 aa, Homo sapiens
SRPEGKSYRNRQSIERNRKFKMGSIQVCRAWARLQPEDDGNHTQKSTFQAETFYMQGVSPGL

SEQ ID NO: 4301 - protein, 82 aa, Homo sapiens
NTSGHTLVRSPTSVAYVARALATVPPASSTSGHTGGSSPPDQWCPDGSHLGQPRQLPRDRRPRTSHISALIAARGLCSAAAS

SEQ ID NO: 4302 - protein, 61 aa, Homo sapiens
EALQVWHMWQGLWRQFRPHQAPADTPGGAAPPTSGAPTAAISGSHGSYPGTEGPGQAIYLH

SEQ ID NO: 4303 - protein, 25 aa, Homo sapiens
RECRSRHWKFRKCSVIFRTDVPDSQ

SEQ ID NO: 4304 - protein, 13 aa, Homo sapiens
EKGQTKTLQTMTF

SEQ ID NO: 4305 - protein, 72 aa, Homo sapiens
QLLMSQEFPVIQLMENVSRKGISLQSRNNIDVMCVIIQVQHMLVSETTGESITLISRTDALCVGMCVAILLL

SEQ ID NO: 4306 - protein, 281 aa, Homo sapiens
PCCPTPPLRAVPASLPKRRRAAESRAHPRVPEPHATPCLRRPPVWRVRQVLWQELYADATPADALGGETLQVPGVRQGLPGERHAGAPPAHTHGREAVRMWRLWTLLQREFHAAAPSAQPSGRAATCVRHLRQGFRAALRPGGAPAHPHGREALRVPRVRPPLQRPLGPHQAPAHAHGREALPLRTVRQAVHVRVQSQRASAQPCRPQATQMPRVQQGLQRRLQACTAPQDAPGRTASGVRRVRQVLQPQPLAVTASAGPHARPHRCRRCHPVRSGHCPRL

SEQ ID NO: 4307 - protein, 239 aa, Homo sapiens
RDTCRRTRGRNPSSARSAARASWRAPRWCATSAHTRARSRTHVATVDAASARVPRCCAIGAAIRASGHMRAPLAARVSGSAPTWWCTSASTRARSPSRAPSAAAASATARTSPSTGARTRARSPTAANCAASGSRACPISTCIGATMPATSHTNAPSAARPSASPPSLHCTARRTWANGQRSAQSAASASATAARCHSISGPTRAPAPLPPLPSSPQWALPSSLRGRLNRKSQGSLCPS

The invention claimed is:

1. A peptide comprising at least two amino acid sequences, wherein each of said at least two amino acid sequences is independently selected from the group consisting of SEQ ID NOS: 601 to 605, or an isolated nucleic acid comprising a nucleotide sequence encoding said peptide.

2. The peptide or isolated nucleic acid according to claim 1, wherein one of said at least two amino acid sequences is SEQ ID NO: 602, or a nucleic acid sequence encoding said peptide, and another of said at least two amino acid sequences is selected from the group consisting of SEQ ID NOS: 601, 603, 604, and 605, or an isolated nucleic acid comprising a nucleotide sequence encoding said peptide.

3. The peptide or isolated nucleic acid according to claim 2, wherein said at least two amino acid sequences comprise SEQ ID NO:602 and SEQ ID NO:601, or isolated nucleic acid sequences encoding said peptides.

\* \* \* \* \*